United States Patent 8,394,390 (NEISSERIAL ANTIGENIC PEPTIDES) - sequence listing, part 3

SEQ ID NO: 37789 - DNA, 56485 bp, Neisseria meningitidis
cggcgaaaatagcggtcaatgaggcgaagcctgccgatgccaatgcccaaaacagccatgcgttgctgcccatgttttctccttggattgtgaacaatatgaacggtatttttgttgctgcgtcaaaaatttcactgcgggtttggtgcggataacgttataatatgcctgatattattttcaatccacctgtttgtcgcctgatgctttcagacggcatgtccctcctcatttctaaaggaaaatcatgagcttcaaaaccgatgccgaaatcgcccaatcctccaccatgcgcccgattggcgaaattgccgccaagcttggtctgaatgccgacaacattgagccttacggtcattacaaggcgaaaatcaatcctgccgaagcgttcaaactgccgcaaaaacagggcaggctgattttggttaccgccatcaacccgactccggcgggcgaaggcaaaaccaccgtaaccatcggtttggcggacgcgttgcgccacatcggcaaagatgccgtgattgccctgcgcgaaccttctctggggccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggtaaacccgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgacgccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctgaacggttttctgaaaccggatgccgtctgaagccgtttcagacggcattttttcggaacgcgggcggcggtatgctataatccgccgttaaatttctctattttcaggaaaaaacatgagtttgaaatgcggcatcgtcggtttgcccaacgtcggcaaatccaccctttttaacgcgctgacccaatcgggtatcgaagcggcaaactatcctttctgtaccatcgaacccaacgtcggcatcgtcgaagtccccgatccgcgtatggccgaattggcaaaaatcgtcaatccgcaaaaaatgcagcctgccatcgtcgaatttgtcgatattgccggtttggttgcaggcgcgagcaaaggcgagggcttgggcaaccagttccttgccaacatccgcgaaaccgatgcgattgtgaatgtcgtgcgctgctttgacgacgacaacatcgtccacgttgcaggccgcgtcgatccgattgccgacattgaaaccatcggcacagagttggcacttgccgacctggcaagtgtcgaaaaagccatcgtccgcgaagaaaaacgcgcccgctcaggcgacaaagacgcgcaaaagctggtcgatttgtgcaaaaaactgctgccgcatctggacgaaggcaaacccgtgcgttccttcggtttggacgcggaagaacgcgcgatgctcaaaccgctgttcctgctgaccgccaaaccggcgatgtatgtgggcaacgtcgccgaagacggttttgaaaacaatccgcacctcgaccgcctgaaagaattggcggcaaaagaaaacgcccccgtcgtcgccgtttgcgccgcgatggagagcgaaattgccgaattggaagacgacgaaaaagccgagttcctcgccgaaatgggcttggaagaaccgggcctgaaccgcctgattcgtgccggttacgacctcttggggctgcaaacctatttcaccgccggtgtgaaagaagtccgcgcgtggacgatacacaaaggcgacaccgcgccgcaagccgccggcgtgattcatacggattttgaacgcggcttcatccgcgcccaagtcatttcttacgacgactttgtctcgctcggcggcgaagccaaagccaaagaagccggcaaaatgcgtgtggaaggcaaggaatatgtcgtgcaagacggcgatgtgatgcactttttgtttaacgtgtaacccaaatgcggcaggtttcaggcggcttgccggaaatgccgtctgaagccgattttgatgattttcggcgtttcccgtaccgccggaatgcagccgcatcaaaataaactcccacccgcatttccgatttgccctccccgattcctgcaaaacaaaccgcctgccccgccgttacgggaagccgtccggcattccgaatatcccgatccccgatacgaaatgacctttcagacggcatttgcgccgccgcgtttcgagtatagtggattaactttaaatcaggacaaggcgacgaaaccgcagacagtatagatagtacggcaaggcgaggcaacgccgtactggtttttgttaatccactataaaaacattatgagccaagccttaccctaccgcccggacatcgacacattgcgcgccgccgccgtcttgtccgtcatcgtgttccatatcgaaaaggattggctgccgggcgggtttctcggtgtcgatatattctttgtgatttcaggctttttgatgacgacgattcttcaccgcgaaatgtcgggggggggggggaggttttccctgaaggcattttatatccgccgcatcaagcggattctgcccgcatttttcgccgtattggcggcaacgctggcaggcggcttctttttattcaccaaagatgatttctttcttttgtggaaatccgcgctgaccgccttgggtttcgcctctaacctgtattttgcaagggggaaggattatttcgatcccgcgcaggaagaaaagcccctgctgcacatctggtctttgtcggtcgaagaacaattttactttgtctttccgatactgctgctgcttgtcgcccgcaaaagcctgcgcgtacagttcggcttccttgccgcactgtgtgccttaagccttgccgcctcctttataccttccgcgctcgataaatattacctgccccacctgcgcgcctgcgaattactgataggatcgctgaccgccgtgtggatgcgctgccggcaacctgccgtcggcagacgctgtgccgccgtcggcgcattgtttgccgtgtgcatattgtcaacctgcctgttttcctattcggaacaaaccgcctatttcccgggccccgccgctttgattccctgtctggctgttgccgcgctgatttatttcaatcattacgaacacccgcttaaaaaatttttccaatcgaaaatcactgttgccgccggtttgatttcctattcgctttatctgtggcattggccgatattggcctttatgcgctatatcggcccggacaacctgccgccttattcgccggcggcggcggtcgtcctgatattgctgctttccctgttttcttaccactgcatcgaaaaaccgtttaaaaaatggcaaggttcgttcgcacaatccgttttatggatttatgccttgcctatgctcattttgggggcgggctcgttttttgcgatgagactgccgtttatggcgcaatacgaccgcttggggctgacgcgttccaacacctcctgccacaacaataccggcaaacaatgcctatggggggatacggaaaaacagccggaactgctggttttgggcgactcccacgccgaccattacaaaacattcttcgatgccgtgggcaaaaaagaaaaatggtccgccactatggtttccgccgacgcttgcgcctatgtggaaggctacgcgtcccgtgtgttccaaaactgggcagcctgccgcgccgtttatcgctatgccgaagaacacctgccccggtattcaaaagtggttttggcgatgcgctggggcagccaaatgcccgaaaacagccgctcccttgcctatgatgccggttttttccaaaaattcgaccgtatgctgcataaactctcgtccgaaaaacaagccgtttacctgatggcggacaaccttgcctcgtcttacaacgtccagcgcgcctatatcttgtcttcacgcataccgggttaccgccaagccctgcgcccggacgacgaaagcaccctgaaagccaatgcacgcatcagggaattggcagccaaataccccaacgtctatattattgatgccgccgcctatatccccgcagattttcaaatcggcggattgccggtttactcggacaaagaccacatcaacccttacggcggcacggaattggcaaagcgtttttccgaaaaacaacggtttctcgatacgcgccataaccattgattcgcttaaatttgttacaatcggcggtttgcaaaaacgctaattttttttgaaagagaccgatgagcgtcatccaagacctgcaatcgcgcggccttatcgcgcaaaccaccgacatcgaagccttagacgctttgttgaacgaacaaaaaattgccctttattgcggcttcgacccgaccgccgacagcctgcacatcggacacctgctgcccgtattggcattgcgccgcttccaacaggcggggcatacgccgattgctttggtgggcggcgcgaccggtatgatcggcgaccccagcttcaaagccgccgaacgcagcttgaattccgccgaaactgttgccggctgggtggaaagtatccgcaaccaattaacccctttcttgagctttgaaggcggaaatgccgccattatggcgaacaatgccgactggttcggcagcatgaactgccttgacttcctgcgcgacatcggcaagcatttctccgtcaacgccatgctgaacaaagaatccgtcaaacagcgcatcgaccgcgacggcgcaggcatttccttcaccgagttcgcctattccctgctgcaaggttacgacttcgccgagttgaacaaacgccacggcgcggttttggaaatcggcggctccgaccaatggggcaatatcaccgccggtatcgacctgacccgccgcctgcaccaaaaacaagtattcggtctgaccctgcctttggtaaccaaatcagacggtaccaaattcggcaaaaccgaaggcggcgcggtatggctgaacgcgaaaaaaacctcgccctatcagttctaccaattctggctgaaagtcgccgatgccgatgtgtataaattcctgaaatactttaccttcctgtccatcgaagaaatcgatgccatcgaagccaaagacaaggcaagcggcagcaagcccgaagcgcaacgcatcctcgccgaagaaatgacccgcctgattcacggcgaagaagcccttgccgccgcgcaacgcatttccgaaagcctgtttgccgaagaccaaagcagcctgaccgaaagcgacttcgagcagctcgccctcgacggcctgcctgcatttgaagtttcagacggcatcaatgtcgtcgaagccttggtaaaaaccggtttggcatcctccaataaagaagcgcgcggctttgtgaacagcaaagcggttttgctcaacggcaaacctgccgaagccaacaaccccaaccacgccgccgaacgccccgacgatgcctgcctgctgaacggcgaacacaaacgtttcggcaaatacactatccttcggcgcggcaaacgcaaccacgcgcttttggtttggaaataatccgattgccgcagaaatgccgtcattcccgcgcaggcgggaatccggacctgtccgcacggaaacttatcgggcaaaacggtttcttagattccacgttctagattcccgcctgagcgggaatgacgagtttcaagattacggtgttgtcggaacgcaactgaaccgtcattcccacgaaagtgggaatctagaatctcggggtttgagcaactgtttttatccgataagtttctgtgcggacaggtccggattcccgcctgcgcgggaatgacggcggagggttgtttgtctcggtttacctggttaaaaaagaacgattttcactgatgttgcatcaggtttggggcgatgtttcaacacatagcaccgcgcctgctgcgcgtttttgtgcgtttggcgcgttcggcggcgggaaatttgcctacttttcccgcgtcgggcgggcgtaacgggcggcacactgtctataaaccgcaataccgtttacaatgaccgcctgtttcaccacatacccgaatgcaacaatgagaatcaggctggggcggcacaacgcgcccgactttccacagggtgccgccgtaaccataggcaatttcgacggcgtacacctcggacacaaacacatcctccaaaaactccgcctcgaagccgacgcgcgcggactgcccgtcgtgaccgtcgttttcgaaccccaacccaaagaatttttcgcactccgcaccggcaggatgccaccgtgtcggatcagccccctgcgcaccaagctcgaattattggaaggcacaggctgtgtcgatgccgtctgggttttgcgtttcgatcaaaatttttccgaaatatccgcgcaagggtttatcgaccgcctgctgcgtcaaaccttgaatacgcgttatttgctcgtcggcgatgatttccgtttcggtgcggggcgggaaggctgttttgaacttttggcacaacagcccgatatgcagaccgagcgtacgccttccgtcatcgtcgaagacatccgcaccagcagtaccgccgtgcgacaagccctttcagacggcaaccttgcctatgcgaaaaaacttttgggacacgactacgtcttgagcggcagggtggtgcacggcagaaaactcggacgcaccttaaacgccccgactgccaacatccgcctgccccgccaccgttatgcactcggcggcgtgtttgtcgtcgaagcagacggcgcattcggcacgcggcgcggcgtggcgagtttcggcttcaatcccaccgttgatagcggctgttctcaaaagcttgaagtccacctgttcgactttcaaggcgacctgtacggacaagggctgaacgtccgcttcctgcacaaactgcgcgatgaggaaaagtttgacggtatggaagaactgaaaaggcagattgaagccgatatggaagccgcaaggcgttggtagaaaaaccttatacaaaccatccgattgggctacaatcaatcttttaactgttcagacggcacagggttttcccgttgtgaaatgctgtttggggcgcaatgccgtctgagaccgaaatattgtaacaatagagattaaaaaatgaccgattacagtaaaaccgtaaacctgctcgagagcccgtttccgatgcgcggcaatcttgccaagcgcgagcctgcatggctgaaaagctggtacgagcaaaaacgctaccaaaaactgcgcgaaatcgccaaaggccgtccgaaatttattctgcacgacggcccgccgtatgccaacggcgacatccacatcggtcatgccgtcaataaaattctcaaagacatcattatccgcagcaaaacccaagccggttttgacgcgccttatgtgccgggttgggactgccacggcctgcccatcgaagtgatggtagaaaaactgcacggcaaagatatgcccaaagcacgtttccgcgaattgtgccgcgaatacgccgccgaacagattgcccgtcagaaaaaagactttatccgcttgggcgtgttgggcgactgggaccatccttacctgactatggatttcaaaaccgaagccgataccgtgcgtatgctcggcgaaatctacaaatccggctatctctaccggggtgcgaaaccggttcaattctgcttggactgcggttcttcgctggccgaagcggaagtggaatacaaagacaaaatctcgcccgcgattgacgttgcctatctgtttaaagacactgccgcgcttgccgccgcattcggtttggctggtttcgaaggcaaagcgtttgccgtcatttggacgactacgccttggacgctaccggcgagccaagccgtgtctgcgggtgcagacgtggtgtatcaactgattgatacgccgaaaggcaaattggtattggcgaaagatttggcagaagacgcgctcaaacgttacggtttttcagacggcattgctattctcgccgaaaccaccggcgacaagctggaaaatctgcacatgaaccatccgttcctcgaacgcgatattcccatgctcaacggcgaacacgttaccaccgatgccggtaccggcttggtacacaccgcccccgcgcacggtttggaagactacgccgtctgcaataaatacggcatcgagctttacaaccccgtcaacgccgaaggccgatacatcggcgaaacgccgcgtgtcgccggtatgcgcgtttgggaggcgaaccccgtcatcctgcaatggttggaagaaaccggcaaccttttggcaagcagtaaaatcgaacacagctacgcccactgctggcggcacaaaacgccgctgatttaccgcgcgacaggtcaatggtttgtcggtatggacaaagccggtgccgacggcaaaaccctgcgcgacaaagccatcaaggccgtggacgacaccgaattcttcccgtcttggggtcgcgcgcgtttggaagccatgattgaaggtcgtcctgactgggtggtttcacgccaacgctattggggcacgccgatgactttctttgttcacaaagaaacgggcgagctgcatccgaactctgccgaacttttggaaaaagttgccctgaaaatcgaagaaaaaggcatcgaagcgtggttctccctcgataagagcgaactcttgagcgcggaagattgcgaaaattacgataaactttctgacacaatggacgtatggttcgactccggctcgacccattattccgttgtgaaacaacgcgaagaattggaatggccggctgatttgtatctcgaaggcagcgaccaacaccgcggctggtttcaatcgtccatgctgaccggctgcgcctcatcaatgggtcgcgcgccgtataaacagctgctgacccatggtttcgttgtcgacggcgaaggcaaaaaaatgtcgaaatccatcggcaacgtcgttgcaccgcaagaggtttataacgaattcggcgcagacatcctgcgcctgtgggcggcatctaccgattacagcggcgaattggcgatttccaaagaaatcctcaaacgcgtaaccgaaagctaccgccgtatccgcaataccttgagctttttgtttgccaacttgagcgactttaatccgattgaagatgccgtgcaacaggcggatatggtggaaatcgaccgctacgccgtggtattggcacgtcagctgcaagagtgtctggcaggcgattactatccgcgttatgccttccactttgccgtaaaagacattgtttctttctgctcggaagacttgggtgcgttctacctcgacatcctgaaagaccgcctctacaccaccaaagcagacagccatgcacgccgcagcgcacaaactgccctgtatcacatcacacgcagtttggttctcttgattgcaccgattttgtgcttcaccggcgaagaagcgtgggacatcatcggcggcggcgaagaagacagcgtcctcttccatacttggcacgagttcccgaccatcaacgaaaaaaccgaagccgaactggtgaaaaaatggacggcaatccgcgaagcccgcgaagcggtaaccgccgccatcgagcctttgcgcgccgacaaaaccgtcggttcgtccttgcaagccgaagccgaaattaccgcgccggaagaaatggccggctatctgaatgctttgggcgaagaattgcgctttgctttgctggtgtctaaagcagaagtgaaagtaggcagcgaacttgccgttgccgctaaagccagtgatggtgaaaaatgcgaacgctgctggcactacacccgcgatgtgggcgcggttgcaggctatgaaaccgtctgcaaacgctgtgcagagaatgtcggcggagaaggcgaaacgcgccattacgcctgataaagtttgagcaaatgccgtctgaaaccgccgaacagcatttcagacggcattttttgtgccgcgatttgtctttataacggcggaggggtttcaagattgcggtgttgtcggaatgcaactgaaccgtcattcccacgaaagtgggaatctagaatctcgaggtttcagtcatttccgatagattcccgcctgtgcgggaatgacggatttcgagattacggtgttgtcggaacgcaactgaaccgtcattcccacgaaagtgggaatctagaatctcggggtttcagtcatttccgatagattcccgccgcgtcggaggtctggattcccgcctgcgcgggaatgacgggtttcaagattgcgctgttatcgggaatgacggatttcaagattacggtgttgtcggaatgcaactgaaccgccattcccacgaaagtgggaatctagaatctcggggtttcagtcatttccgatagattcccgccgcgtcaggggtctggattcccgcctgtgcgggaatgacggatttcgagattgcggtgttgtcggaacgcaactgaaccgtcattcccacgaaagtgggaatctagaatctcggggtttcagtcatttccgatagattcccgccgcgtcaggggtctggattcccgcctgtgtgggaatgacggatttcgagattgcggtgttgttggaacgcaactgaaccgtcattcccacgaaagtgggaatctagaatctcgaggtttcagtcatttccgatagattcccgccgcgtcggaggtctggattcccgcctgcgcgggaatgacggatttcgagattgcggtgttgttggaacgcaactgaaccgtcattcccacgaaagtgggaatctagaatctcgaggtttcagtcatttccgatagattcccgcctgcgcgggaatgacggatttcaagattacggtgttgtcggaatgcaactgaaccgtcattcccacggaagtgggaatctatagtggattaaatttaaatcaggacaaggcaacgaagccgcagacagtacaaatagtacggcaaggcgaggcaatgccgtactggtttgaatttaatccactatagaacgcggggtttgggcaactgtttttatccgataagtttctgtgcggacaggtctggattcccgcctacgcgggaatgacgggtttcgagattacggtgttgtcgggaatgacgggttttaagattacggcatttgccgtttcgggtacaggaaagggggttttcgggtaaaatggtactcttttaccggctgttgaaaaatatgtcttcatctgtttcaagtaaaacgcgctattgggtattggcacttgccgccatcgtgctggaccagtggtcgaagtgggcggtgctgtcgtcgtttcagtatcgggaacgcgtcaatgtcattccttcctttttcgatctgacgctggtgtacaacccgggtgcggcgttcagcttccttgccgatcagggcggctggcaaaaatacttttttttggtgctggcggtggcggtgagcgcgtatttggtacgcgccatcttgcgcgatgagtttgcaaccctcggcaaaacgggtgcggcaatgattatcggcggtgcgttaggcaatgtcatcgaccgcctgatacacggtcatgtcgtcgatttcttattgttttattggcaaaattggttttatcccgcctttaatattgccgacagctttatctgcgtcggtgcggtgttggcggtgttggacaacatcgtccaccgtaaaacccaagaagaaaaatattgatgccgtctgaaaacgaaataccgggcttatgaacgagaaaaccatcatccttgccaatccgcgcggcttctgcgctggtgtggatcgggcaatcagtattgtcgaacgtgctttggaagagttcggcgcgccgatttatgtgcgccacgaagtcgttcacaacaaattcgtcgtggacaacctgcgtgaaaaaggtgcggtgtttattgaagacttggcggaagtgccgccgggcgcgacactggtttattcggcacacggcgtatcgaaggcggtgcggcaagaagcggcggagcgcggtttccgcgtgtttgatgcgacttgcccgctggtgacgaaagtgcataaggaagtcgcccgactggatgcccaagactgtgaaatcatcatgatcgggcataaggggcacgtcgaggtcgaaggaacgatggggcagcttgcgccgggcaaaatgcttttggtcgaaacggtcggagatgtggcaaaactcgaagtcagaaaccccgacaaactcgcctatgtcagccaaaccacgctctcggtcgatgaaaccaaagacatcatcgccgcgctgaacgcgcgtttccccaatatccgcaatccgcacaaggaagatatctgctatgcgacgaccaaccggcaaaccgccgtcaaagagttggcagaacagtgcgacatcgtgattgtggtcggttcgcccaattcgtccaacagcaaccgcttgcgcgaagtggcggcatcgcgcggaatcgatgcgtatatggtggataatgcaggctacctgcaacgcgcatggtttgagggcaaaaacaaagtcggcgtaacggcaggcgcgtccgcgcccgaagtgttggtgcgggaagtactggcaaccatacgcggatgggggcacgaaaccgtacgcgaaggcgagggtgcggaagaaagcattgtgttcgtcctgcccaaagagttgcgccgcgagggcgaaaccaaacccgatttgtgcaaacgttgacgcaggcgttgaatgtttgggcaacacaaatgccgtctgaacaggcttcagacggcatttttgccgtgtgccggatgcggaaaccaatcaggcgtaatgttgtgcaagaaaaccgggcagttcggacaaaccgtccaatacggcgagatgcggtgcgctaaggagctgttcgcgcgaatgtgcgccggtggccacgccgactgccgccgcgcctgcgtttgccgccatatgcaggtcgtgcgccgtatcgccgacgaccaatgcctctttcgggtcgagtcccagttcgccgcagattccgaataccatttcgggcgagggtttggagggatattcccccgcgcaggcggtggcgagccaatagccgccggtggcggtttgactgatggcgttgtccaaacccgcccgccctttgcccgtggcgacggcaagccagtatccttgtgctttgagcttgtccagacagggcagggcatcgggaaataaggacatattgcggttgttgggattgaggtaatgtgcggaataagtgcgtgtgatgtcggcaacggcggtttcagacggcatttcgagcagggtgcggatgatttcgggcaggctgtagccaatcaggctgcggacgcgttccgcttcgggcggcggaaaaccgcattcggcgaagctgcggcgcatggtgtcgatgatgggttgggtcgtatcggcaagcgtgccgtcccagtcgaagatgatgagtttgggcgtggtcatagcaggttggttgcagtaaaaaagcaaattttatgcggaaaacgcagacgtgtcgcattttcgacaaaatttgtcggctgcgcgatatgtttttccgaacaagccgcgttgcgctttattaaaatagaaccattatcatttatgtgaatgggacagtttatgtcagttttccgcatcaatatgaccgccgccacggttttggcagcactctcgtcttcggtttttgccgcacaaacggaaggtttggaaaccgtccatattaagggtcagcgttcttacaacgcgattgccaccgagaaaaacggcgattacagctcgtttgccgccaccgtcggtacaaaaatccccgcttctttgcgcgaaattccgcaatccgtcagcatcattaccaaccagcaggtcaaagaccgcaatgttgatacgtttgaccagttggcacgcaaaacgcccggcctgcgcgtgttgagcaacgacgacggacgctcttcggtttacgcgcgcggttacgaatacagcgaatacaacatcgacggcctgcccgcgcagatgcagagtatcaacggcacgctgcccaacctgttcgccttcgaccgcgtggaagtgatgcgcgggccgagcggactgttcgacagcagcggcgagatgggcggcatcgtgaatctggtgcgcaaacgcccgaccaaagcgttccaaggtcatgcggcggcagggttcggtacgcacaaacaatataaagccgaggcggacgtatcgggcagcctcaattcagacggcagcgtgcgcggccgcgtgatggcgcagaccgtcggcgcgtctccgcgtcccgccgagaaaaacaaccggcgcgaaaccttctacgcggcggcggattgggacatcaaccccgatacggttttgggcgcgggctatctttaccagcaacgccgcctcgcgccgtacaacggcctgcctgccgatgccaataacaaattaccgtccctgccgcaacacgtatttgtcggcgcggattggaacaaatttaaaatgcacagccacgacgtgttcgccgatttgaaacattacttcggcaacggcggctacggcaaagtcggtatgcgctattccgatcggaaagccgattccaattatacgtttgcgggcagcaaactcaacaataccggacaagccgacgtagcgggtttgggtacggacattaaacaaaaagcctttgcggttgacgcaagttacagccgtccgtttgccttgggcaacaccgccaacgaatttgtgattggtgcagactacaaccgcttgcgcagtactaatgaacaagggcgttcgactttgtcaaaaagcgtcgctttagatggtttccgcgctttgccttataacggcatacttcagaacgcccgcgccggaaacaaaggtttcaatcactccgttaccgaagaaaacctcgacgaaaccggtttgtatgccaagacggtgttccgtcctctggaaggtttgtcgttgattgcaggcggacgtgtaggacatcacaaaatcgagtcgggcgacggcaaaaccctgcataaagcttcgaaaaccaaatttacaagctacgccggcgcggtttacgatatagacggcagcaacagcctgtacgcttccgcctcccaactctacacaccgcaaaccagcatcggcaccgacggcaagctgctcaaaccgcgcgaaggcaaccagtttgaaatcggctacaaaggcagctacatggacgaccgcctcaatacccgggtttcgttctaccgcatgaaggataaaaacgccgccgcaccgctggactcaaacaacaaaaaaacccgttacgccgcattgggcaaacgcgtgatggaaggtgttgagaccgaaatcagcggcgcgatgacaccgaaatggcaaatccatgcaggttacagctacctgcacagccaaatcaaaaccgcctccaattcgcgcgacgaaggcatcttcctgctgatgcccaaacacagcgcaaacctgtggacgacttaccaagttacgtccgggctgaccatcggcggcggcgtgaacgcgatgagcggcattacttcatctgcagggatacatgcaggcggttatgccacgttcgatgcgatggcggcataccgcttcacgcccaaactgaagctgcaaatcaacgccgacaacatcttcaaccgccattactacgcccgcgtcggcagcgagagcacctttaacattcccggttcggagcgcagcctgacggcaaacctgcgttacagtttttaaagaccaatatgccgtctgaaacggcagccgcagcatcatcaaactacaacaagctgcgcggcataccctatgctctcacaactggagtatggcattgcgaaggaaaatagaccgaaccggcaggcagaccgctttgccggttcggttttaccgcttgccgccagtctgacccacaagccgaacatcatgaaacccataccgaccgacacattccaacctgccatactgccccaagcctttgaaaccgaaatcaaatccacctgcacggggcgaatctatcggattcagacggcaacactcggcgaaataccgtctgaaggctatcccgtcctctttgtcctcgacggcgaagcctttttccccgcacttttcaacatcatgcagtcgctgatgaacaaccccgttacccgaagcaacgccccctgcctgattgtcggtatcggctacacgacaggcagtgtgcgcgatttggcacaacgtgccgccgactacacgccgccgcttggagacaacgccacagcagacgaacggcagcagttcggacaggcagaccgcttcgccgcctttatcgacagcgagctgaccgcctttttagaaagccgctacaccctcaaccgcaatgaaaccgccgtattcggacactcgttcggcgcactgttcggactgtattccctgctttcccaccgccgtttcagacggcattggctcgtatccccatcgatttggtggcacaacaggcggatactcgactttatgccgtctgaaaaccggctaaacggcatcgatgtctgcctcaacatcggcgcgctagaacggggtagcgattgtaaacgcagggaagaacgcgatatggcagggcaggccgaacaaatggcggcagagttagacaggcacggggccgccgtctttttccgggaatatccgaatgccgaccacggcaatgtcccgttctactcgctgaccgattgcgtcgaatatttgaggaaggcttggcagaggtagggggaattaaatatatgactgctttgttttgcatcggaaaataacaagagctacctaagggttattgctccctttctcattttattttgatataaaaatccctgcttcaggccgtctgaaacagggataggttaatttaacggacgggtgggcgttttttcaggcggcacggtctgatttctttgcccggtttgtcgatttggtatttttggagtgaaagggcggttttgataccgatactttggaaaatgccgtttttccctttggtgctgtctgtgtcatgcacacggatatcaatcgtcccggttgctctatttagactggcgaaataaccaaaaaatacgtttttcttggcagttacttttattcaatcattcgaataaagtacgaatgaaaccggtttttgggcttcagacggcatttatattttgggttaccagttgacgcgcaccgaccggctgccgagcaatgtttccagttcgccgaacaatgcggagctcggtgtaaccgtccatttcggcggcacttgaagcctgcccgacgctttttcgttggcatacgacagttgcagcgggatgcgcggcgtgtcgggcagttggtgggcggcgagcagccgtaccagtccgccgatgtcgtgatgcggggcgagggcgaggctgaggctgcgggcgtagcgttcgcgcgccgtttgcagggtcatgacttggtttgccagaatacgcagcccgtcgccgccgccgtagtcgtcgcggctgactttggattcgataatcagcacttggtcggctttgaggcagtcggcgcagttttccaacgtctgaccgccgaccatgatttcaacctgtccgctcaaatcttcgaggctgacgaaggcgattttgccgcgtttgcccatcatcgtacgcacggcggtaacgaatccggcgaggcgcacgctgtcttgcggcttcagacggtctaatttggtcggtgcgatttggcggacttcttgggcatacgggccgaacgggtggccggacaggtaaaagccgatgacggttttttcttcggcgagtttttccgattcgctccacatcggcgcgtcgatgagccgcaccggttcgatggcgtcttccatcatgtcgaaaagcccgccctgattggcgttggcggctttttggtcggcgttgtccatagcgaggtcgatgttcgccaagagcatggcgcggttgggttcgatgctgtcgaacgcgccgccgcgtatcagggcctcgagggtgcggcggttcatgtgttctttgccgacgcgctcgcagaagtccaacagaccggtaaacttgccgccgctttgccgcgcggcggtgatggattcgacggcggcttcgcccgtgcctttaatcgcgccgagcgcgtagcggattttcatgtccggatacggcgtgaagcggtagtcggattcgttgatgtcgggcggcaggaactcaatgccgttggcgcggcagtcgtcgtagaaatgcttgagctggtcggtgttgtccaattcggacgacatggtcgccgccataaattcggcggggtagtgcgctttaagccatgcggtctggtaggaaatcagggcgtaggcggcggcgtgggatttgttgaaaccgtagccggcgaatttttccatgtagttgaagatttcgtcggatttttcgcgcgaaatgccttgttttgccgcgccttcggcgaagatttcgcggtgtttcaccatttcttcgggttttttcttacccatggcgcgacgcagcaggtccgcgccgccgagcgagtagccgccgataatttgcgccgcctgcatcacttgttcctgatacaccataatcccgtaggtcggcgcgaggatgccttcgagtagcggatggatgtattggaattcttgccccttcatacgtgcgacgaagtcgggaatgttgtccatcgggccggggcggtagagcgatacgaaggcgatgagttcttcaaacttggtcgtgtgcgccgttttcagcatttttttcatgccggtcgactcaaactggaagacggcggtggtgttcgcatcgcggaagatttggtaggcgacctggtcgtcaagcgggattttgccgacatcgatgatgtcgccggtagtgtttttgatgttgttctgcgccatttcgataatggtcaggttgcgcagacccaaaaagtcgaatttcaccaaacccacatcttccacgtcgcccttgtcgtacatggatacgggcgaggcggattcgtccgcctgatacacggggctgtaatcggaaatcttgcccggcgcaatcaacacgccgcctgcgtgcatacccaaaccgcgcgttaaatcttccagctttttcgccagcgtaatcagttcgtccgcttcttccgcttcgattaattcctgaatctgtggctcggtctccatggctttttccaaactcaggggtttgttggcttccaacggaatcagcttggacagtttgtcgcacagcataaacggcagctctaacacgcgcccgacgtcgcggatgaccgctttggacgacatcgtgccgaaggtaacaatctggctgaccgcctccgcgccgtatttctcgcgcacatattcaatcacgcggccgcggttgctttggcaaaagtccacgtcgaagtcgggcatagaaacgcgttcggggtttaggaaacgctcgaacagcagcgcgtatttgagcggatcaaggtcggtaatcttcaatgaatacgccaccagcgaacccgcgcccgaaccacggcccggcccgaccggacagccgtgtgttttcgcccagttgataaagtcttgtacgataaggaaatagccggggaatttcatttggatgatgatgttcagctcaaaatccaaacgttcctgatattccggcatttttgccgcccgctccgcctcgtcgggataaagctgaaccatacgttcctgcaaaccctcgttggagagtttgatgagatagtcatcgagtgataaaccgtcgggcgtggggaaaaggggcaggaagtttttgcccaatgtgatgtgcaggttgcagcgtttggcaatttctaccgtgttttccaaggcttcaggcaaatcggcgaaacgttcggccatggtttccggcggaatgaaaaactggcccggcgtgaaatcgcgcggacgtttcttgtccgtcaatacccagccgcctgcgatacacactcgcgcctcgtgcgcgttgaaatcgtcgcggctcataaactgtgtcggatgcgtcgccaccaccggcaaacccaattcctccgccagcttcacgctgcccgaaacgcaagcctcccattcggggcgttcgggtaggcgttgcagctccatatagaacgcatcggggaaccacgccgcatacttcaacgccgccgtacgcgccgcgtcttcattgccgttcaacagattcacgcccacttcgccgtaatgtgcgccgctcaaacaaatcaagccgctgttgtcgccgttttccagccattcgggattgagttccgcatgatggacattgcggtctttgccgacataagccgccgtcagaagctcgctcaagcgcagatagcccgcatcgttacggataatcagcatagcgcggaacggcttgtcgggcgcatccggattgcctatccgcacatccgccgcgccgataggcttaatccccgcgctgcggcaggctttataaaatttcaccaaaccgaattcgttcatcaaatcgctgatgcccaaagcaggcaaaccgtattcctgcgctttggcaatcagttttttaatccgcaccataccgtcggtaatcgaaaattcggtatgcaggcgcaggggaatgtaggtcggctcggtcatggcaaaatcggcgtggacaataaaaggcgtattgtagcagggttgtctttagatggcggtgtaggtaatgccgtttcgggttcagacggcatgacctgcaaatgtttttgagcttttactacggcaaaaaaatgcctcctgccgtatggcggaggcttcccaaggagtattgatagatataaaggactatcaaactagttataaagaactatatgccttattcggacggatggcaagcagttaaattaattttacgttcaaacaggtttttgatttcgttttgatgccgattgccggtgtatcgggcagttcgcgtttgaggatgtgcatcagcgtcaatgcggattcgtcggggaacaggatttgcagtctgccgttgggcaggatttctttgaacggatggcggcatatggggtttcagacggcatttttacttttacggaacaggcggtgcggatacatcgccggtttttcggtaattttgggtacggcggcggcaggtgctacaataacggcctctttctgcaagggaacattatggaagccactgtctatctcgaagacaacgaatacatcgccttgtgcgacctcttgaaattggtcggacttgccgaaagcggcggacaggcgaaagcgtttatcgccgaagggctggtgttgcgcaacggcgaaaccgaaacccgtaaaaccgccaaaatacgcggcggcgaagtcatcgagtttgacggcgctcgcttggaaatcgccgatggatacgaccctgaagtataaagccgaagcccttttgggcgagccgcttttagacgaacccgtccgacccgagtcgtgggaatgctgcggcagcgactgcggcgaggcgtgcattcagacgatttactgggcggataaagccaaatacgacgtgcaacggcagaaattgaaagaagcgggttggtcggacgatgccgtctgaaacggttcggcttgatatagtgaattaacaaaaatcaggacaaggcggcgagccgcagacagtacaaatagtacggaaccgattcacttggtgcttcagcaccttagagaatcgttctctttgagccaaggcgagccaacgctgtaccggtttaaatttaattcactataaaaccacgttttcagacagtcttttatagtagattaaaactgaaaacgtccatatcgtcattcccgcgcaggcgggaatccggaagttcgaaatagcggttaaccttaaatatttttgacaaatcaaggtctggattcccgcctgcgcgggaatgacggcatagggacttttcctttgcatttgccatacacctgtttgttgaaatcaccgctgtatccacaccaaccgataatattaacccccgaccttcattcacaacacacataacaccccatgatagacctgcactgccattccaccgtttccgacggtatgctctcccccgccgaagtcgtgcgcctcgcgcatcaaaacggctgcacgctgctggcgttgaccgaccacgaccacaccggcggcatcgccgaagcgcgcgccgaagccgacaagctcggtttgcgcctgattaacggtgtggaaatctccgtaacgtggcgcgggcgcaccatacacgttgtcggtttggatttcgacgagcaggacgaaaacctgcaaaacctgttggcgcaagtgcggaaaggccgtctgaaacgtcttgaagccatcgccgccaagctcgaaaagaaaggcatcggcggcgcatacgacggcgcgctggcactggcggcaaacaaagaaatggtcagccgcacccacgtcgccgagttcctcatccaagcgggacacgtcaaaaacaagcagcaggcgttcaccaaatacttgggcgacggcaaatcctgcgccgtccgccacgaatgggcgacgctggaagactgcgtctccgccgtcaacggagcgggcggcatggcagtcatcgcccaccccatgcgctacgatttgtccgccaccgccaagcgcaatttgtttgaagaatttaaaaacctcggcggcgcaggcatcgaagtccacagcggaaactgctgcaaaaacgaccgcctcaactacgcgcttttggcagaacgcttcggtatgctcgccagcgcgggcagcgacttccaccgcttaaacgacttcagcggcggcatcctcggcgcgtgtcccgagctgccggaaaactgcaaaccggtttgggaacatttttcccgatattgaatgcagataaaaatgccgtctgaaaacttttcagacggcattttttgcgttttaaacgttgtcgtacagttttcggacggttttaccgatggcggcaatgcctttttccagcgtttgagcgtcctgcgcgatgctcatgcggatgcactcgcccgcatgcgggtaatcctgcgtgtcgatgccgacgaagaaatgttcgcccggaataatcagtgtgccttcggctttgagcatttcgtacagggtttgcgaagaaacgggcaggttttcaaaccagagccacaggaaaatcgcgccttcgggtttgtggattttcatcgggtacgcgcccagctcccgcttgagcagcgagacggcggtttgcgcctgattgcggtaaaacggccggatgacttggtcggcaagccgtttcatctcgccgctttccagcagcggcgttgcgatggccgcgccgaagcgcgtgggggcaaggttcacaatcgcgttcaggctgctgacggctttgacgacttcgggcgcggcgacgatgatgccggtgcgcacgcccggcaggccgactttggacaggctgaagcagaggatgatgttttcgtgccaattcagcgttacgtcgctgtaaatgatgttggggaacggcattccgtaggcgttgtcgataatcagcggaatgccgtgttcacgcgccaaagcgtccaaacgcgccatttcgccgtcggtcaacacattgccggtcgggttggtcgggcgcgaacagcaaatcgcgccgattttgcccgctttgagttcgggcaggttttccagtgcgtcaaagtccacgcggtatttgaagaagccggcttcgccttcgtgttcgacgttttcgattttgggcttgacggaaacgaagtgctgcccttcgacatgcacgtcggcatagccgatgtattcgggcgcgagcggcaacaaaatggctttttctgcggatgtgccgtctgaaaggttgaatttgccgccgaagaggttgaaaagatagaaaaacgcgttttgcgaaccgttggtcagcgcgatattgtcggcggtcagattccagctgtattcgcggttgaggaaggcggtcagcgcgtcaatcagcacggcatcgccttggggattggagtagttgccgatgttttcgacggcgtgttctgccgccagtttggagaatatgtcggcgaacgcctgatcgatttccggaatgcgcgccgggttgccgccgccgagcatgttgacgggcttgtcgcttttgagcgcgtcgccgaggtcgtccatcagttggaggatgccgctgtgttgcgtgaatttttcgccgaatgctgagaactgcatgtcaaactccgtgtgtgtaaggtaggttggtttgtacgttatgccgtctgaaggttcagacggcattttttctgtgtgtttctcgtacccaaagcaggtcgcagatgccgtcgctcggggcaaagccggtcggggcgttgatgagcagggtgcggattgcctgctggtcgtaacggtcgcaggccgcacggatgcggtcgagcagggcggagagctcgtgccacggcagcatggtctcgttggcggtcatgatgcgcggatggccggttttgcggacgttgtcgccgatgagcagctcttcgtagagtttttctccgggacgcagtccggtaatgaggatttcgatgtcgccgtcgggttgttcgggtgtgttgggtttgaggccgcttagggtaatcatttggcgggcaaggtcgatgattttgacggattcacccatgtcgaggacgaatacgtcgccgcccgtacccatcgcgcctgcctgtatgacgagttgggcggcttcgggtatggtcatgaaataacgtgtgatttcggggtgggtcagggtaagcgggccgccttctgcaatctgtttttcaaacagcgggacaacggagccggacgaacctaaaacattgccgaaacgtaccatgctgaagcgggttttttgtccgggttcggcggcgagtgcctgaaggcagagttccgccatgcgtttgctggcacccatggtgttggtggggcggacggctttgtcggtggagatgaggacgaaagttcttacgcccgatgtcgtggcggcaagcgcgcactcgagtgtgccgaagatgttgttgcgtatgccttcgacggtgttgaactcgaccatggggacgtgtttgtaggcagcggcgtgatagacggtcgcaacggaaaaggcggtcatgacgtgttcgagcagcgtgcggttttgcaccgaaccgagaaagggcaggatttcggtgtcgaggcgtttttggatgcaggtttcgcgcaattctttttcgatggcgtacagggcgaattcggataactcgaacagcagcagcttttcggggcggcggcggataatctggcggcagagttccgaaccgatggagccgcccgcgccggttaccatgacggttttgccttcgatgtcggcactcatcaggcggtcgtcgggcgcgacggaatcacgcccgagcaggtcggacacagagatttttttgagcgtgccgatgctgatttttccgtccatcaggtctttcattccgggaatggtcaacacttcgcacggataggcttccagtttgttgatgattcggcggcgttgttcctgggtcgcgccggggatggcgagcaggattttttccacgccgtagcgttcgatgaggaaggcgatggcatcgggctggtaaacggcaaggtcgtagatgacggtgtgccacagtttggggtcgtcgtctacaaaggcggcggcggaatattcgcgcatttgtttgacggcctcaagcagttgtctgcccgaccgtcccgcgccgtaaatgatgacagggatcatctgttttttggggtgttcggacaacagtccgcgcaaaaccatacgcgagccggtcacggaaacaaacagcagtaagaaatagacaatcggcagggcgaggcgcagcctttcttcaaatatcagcgtattgaggaaaaacaacacggcggaggcgaggctgcccgccagtgcggtggtgaggatgcggaagctgacgaagcgtgtaacggcgtggtaaagccccattcggataaataatgtgatggtcagcaaggcagtcagcaaaaaagactgccagttggcaaaatcgaaccattcgtccgagtagtcggcctttaggctttgggtgaaccaaaaggcaatgaaaatcatcagaaaatcgtgtatgaggaaacagattttcttgatgttgcgcggcagggcgatcagagtttccagattcatatcgtggggcggtatgtgttttcaggcggcatatgccgtctgaagggttatcgtgcggcttcggtcaagacggcttcgatgtgttttttgcaaaacgcaatttcgtcgtcggtcagcgtcgggtgcaccaagaacatcaggctggtgtcgcccaactcgacagcatttgtcaaacgctctttcggtcgccacggcgtgttgtcgaaggctttttccaaatagacttcggagcagctgccttgatagcaggggactttgcgcgcgttcagttcgccgacgatgcggtcgcgcgtccagccgtctttgaggtgttcgggtttgacgaaggcgtagaacttatattgcgcgtgtccgatgtagtcggcgacttcaaccaagcggatgctgctgaatttgcccaaactttccgccagcttggcggcgttttctcggcggcgcgccgtccattcgggcaggcgtttgagctggatgcgtccgatgaccgcctgcatttccatcatacgccagtttgtgccgaaactttcgtgcagccagcggaaaccgggcgcgtgttcgtggttgtacacggcatcgtagcttttgccgtggtctttgtacgaccacattttttcccacagggttttgtcgttggtcgtaaccataccgccttcgccgccggtggtcatgattttgtcttggcagaacgaccacgcgccgacgtgtccgatagagccgacggatttgcctttgtattttgcgccgtgcgcttgggcgcagtcttcgattacccaaagattatgttcttttgccaaagccataatgccgtccatttcggcgggcataccggcgaggtggacgacgatgacggctttggtagtcggtgtcagcgcggctttgacggtttccgcgctgatgttttggctgttcaaatccacatcggcaaacacggggtttgcgcccgcgttcacaatgcaggacgcggaagcgaggaaggtgcgcgaggtaacaatcacatcgtcgcccgcgcctatgcccattgctttgagcgcgacatcgagtgccagcgtgccgttggcaagggcgacggcgtaccgcgtgccggcaaaggcggcaaattctttttcaaattcgcggcattcgttgcccgtccagtagttgactttgttggacagcaggactttggaaacggcatcggcttcttcttgggtgaagcagggccacggggaaaggaaagtgttcagcatgatggtttgtccgtcggttttcagacggcatttccgaccctatgccgtctgaaggggggcgtgttccgaagaatcgggcgcgcgccgcaggtgttgtcaaaatcggtctgtacgggggtgtattttaatcgcttatgctgtcgaggtctcggggtttttgcgcggcagcggctttgccggattgcccgcgacggtcatgccgtctgaaacgtcgcgtacgacgactgcgcccgctccaatggttgcgcggctgccgatacggatctgctggcggctgcacgcgcccgtgcctatccagctttcttcgccgatatgcgtgttgcccgacaggtgcgcgcctgggctgatgtggacgaaagcgttaagcaggcagtcgtgatcgacggtggcggcagtgttcacaatcacgccgtctttcaatacgctgcctgcctgtacgacggctttcgccataacgacgctgccttgtccgactgttgcagaaggcgagacggtcgcgtccggatgaaccagaacgggcagggcgaagccgagcgcggcggctttttcggcgatttggcggcggatgcggttgttgccgacggcgacggcgacgtcgtattgttcgggcgataaactgttttcaagcagcagcgtcgtgccgatgacggaaaagccgttgacgctgccttgtgcgcggtcgtccagaaaaacgatttccctgtaccggccgagtgcggcggcaaggtcggcaacgacttttccgtgtccgcccgcaccgacgacggcgagtttgcgttttcctgtgaaagggggcatggtggcttcgccctgtgcggaaatcccttccttgattaatacttttttaaccgtcagcagtaggattttgatgtcgaggcacaggctgaagtggtcgatataccaaacatcgcaggcgaatttttcgtcccacgaaagcgcgttgcgcccgttgacctgcgcccagccggtaatgccgggtttcatttcgtggcggcggttttggaagttgtcgtacagcggcagatattgcatcagcagcgggcgggggccgaccaggctcatctcgccttttaagatattccataattcaggcagttcgtccaaactggcggcacgcagttttttgccgaacggtgtcaggcgttctccgtcgggcagcggaatgccgtctgaatcaagcgcgtcgcgcatggaacggaatttgaccattttaaaaggttttccgtcctttccggggcgttcctgaaagaagaagacgggcgaacctagattcttgcggatgaggtatatcaaaatcaaaaatactggcgagaggaaaatcagtcccgaggcggaggcaacaatgtcaaacaggcgtttgaagaatttactcatttgccaatctttcaatcaggttgacgattttccgataggaaatgtcgcgcctgaagcggcggacgatttcgtcggactgaacggggtcgtttttgcacgccatttggcaatcgatgatatcgtgcccgtgccgcccaagcctgccatagatgtggtcaaaacgattttcataatgggaaaccttgttttttcaaataatgaaacagtttgtgcaaatctttccggtggcgcaggatgcagcctgccagatatgccgcccatacgccggcaaacaggggatagtttgccggcgtgccgaagcaggtgtaggccgccgaggaggtcaggcagaacaatgtgtgcagataaagcggcaggcgtttgagcggctgccacaggcggcaggagctttcggtcttgaaggcaaaaaacagccagaatgaggcggcacaggcaaccgccgcgccgcgcgcgccgccggacggcacggcaagccccagcagcagcaggtttgccgccagcgcgcccaaggtggcgagcgcgatcgggcgcgttttgcggacgacgttcaaaccgatgccgctgatttccgccagcgtgcaaaacagcggcggcagcatacacgatacgacgataaaccggacggcggcgtagttttccggcagcaggagggaggcaaggggcgagaaaatgccggtcaggcagagggcggaggcaagcagggcggcggcggattctgccgttgccgagaggcgggcgggcggggcgttttcttcgattgcgcggaaaatatacggtgtccagaccgttgaaaagatgctttggaacaataatgccgccccgccgaacgaaatacccatcgaataaacgccgagctgttccaggccggcatattttttcaggaacaaacggtcggcggatgccagcccccaataggcgatgctgctcagtgcgatcggtatgccgtagcgcagcccccggtgcaggacggcgggcgaaaacggtgcgtgccggacggccttcagacggcatcggttttgaaacagcaaaaaggcggcggcggcaaggtttgccagcgcgtaaacggcggtcaggacggcggtgttcgctggaaagtgcagcagcccgaccgtcagcggcagcagcagcaggatggcgagcttgggcacgagttgcgcggacgaaaaggcaagggcgcgtccttccatacgcaaaaccagtaagagaaagcggatgggcaggaagctcagttcaaacagcaccagcccgatgccggcggcggcatcgtcgagtgaaaacaggatttcagacggcagggacgggcgggaaagcagcagggcggctatcgcggcggcagacagcagcggcggcaggaacagggttttgaacaaggtgtctttgtcggcggtggcatagtattcgcggacgtatgcctgatccagcccgaggcacaacaccgacaccgtcagccccgccgccgtctgcatcagcacgatgcgcccgatgtcgtcggcggggaaataccacgacagcagcggcaggatgatgacggctaaaaccgcgctgccgatcgagcctgccgcgtagccgaggatttcttttgtgtccatttttgatgtccgggcggcggcgggatgctgcctgtgccgtctgaagcctttcttgatcggaatttgacggctttcagaccgtcgcggctgccggcggggtgcggcagtccgggttgcgttttttcgggcgggcggcggtctgaacggggccgttttttatcggcgttattatatagtgaaacggcgcaaaccctttaaaaggcgttgccgttttttcggaacacggttttgatgttgtgtccgaggatttcgcttgaaacgggtgtccacaagggcggtgcggaaagggcggcgcggttttcgagcagggaaaacaggtctttgccgctgccgaggattttgggcgaacggtacaggacgatttcgtctgccagattttctgccaaaaatgcggatgtgagttcggagcctgcttcgaccatgatttcgccgaaaccttcgtcagcaaggaggcgcatcaggtggtgcaggtcgattttgctgtctgccgtttcagacggcatcaggatgcggacgtgtgcgtgttcccgataggggtgcagtctgtcttcgttgcgttcgagtgtggcgatgtaggtcggagattgtccgtcggtaaccaaatggctgttcgggggcaggcgcaggcggctgtctaaaacgatgcgtgcgggttggcgcaaagttggaaaagcgcggacgttgagccggggattgtccgccaacaccgtgccgatgccggtcagcaccgcgcagctttcggcacgcaaaacctgtacgtcggcacgcgcgtcttcgccggtaatccaaaagctgctgccgtctgaaagggcggttttgccgtccagcgaaacggcgcatttgaggcggacaaaggggcggcggcgttcgatgcgcgacaggaagcctcggttgagttcccttgcctgatgttcgagtaaaccgcattccgtcttgatgcctgctgcttcgagcagggcaagccctttgcctgcaaccagcgggttggggtcgcgcatggcggcaacgacgcgggacacgcccgcccgcaccagtgcttcggcacagggcggtgtgcgcccgtaatggctgcacggttcgagggtaacaaaggcggtcgcgccttgtgccatttcgcccgcctgacgcagggcgtggacttcggcatggggttcgcccgctttgacgtggaagccttgcccgacaatttggctgccgtgtgcgataacgcagccgacgcgcggattgggcgaagtggaaaaacgccccaaagcggcaagtcggagggcgttttccatcatggatatatctgtgtccgaaaacatagggataccgtatcagtatgggttgggggaatcaggctttgccgcctgttttgacggcttgcgccagccacgaggcaaagtctgccggattgtcgaagcgtttgtgcagggcggcgaaacggacggcggcttccgtatcttgtcggagcagttcttttagcaccatgtcggcaagtgcggcagaggggatgtcgcgctgacccgaagtgtagagcctgtgttccgtcaggcggacggtttcgtcgatctgttcgggtgtcagggcggattttcgggcggcggcggtcaggtcgttgcggaggcgttgtgcattaaagggcgagcgttttttgtccggaccgatgacggcgggcattttgagttcggcggtttcgagcgtgccgaagcgtttgccgcagttggggcagtggcggcggcggcgcacggcgttgcgttcttccatcagacgcgaatcggcaacgcgggtgtcggggtgggcgcaaaacgggcatttcatcgggttcgtcctcctatgtcgtctgaagttcagacggcgacgccggcggcgcgggcgatttccagaccttcttcggcactcatatagacggggttttcgggacggtcgtgtcggacgatgttgccttcgcggaacatgaccagttcgtccacggcaagttgggaccatgattcgtcgcgggtcagtggcagggtggcgataacggcgacgcggtcggagggcgtggttacttcggcaaaatcgaccatcacgtcgtcgtcgagcaggcgcgccttgccgaacggggcttggcggacgatgtagtgcagcagcgtgctggcgtgggcaaacagggcaatgccgtctgaaagcataaagttaaacagcccgaacttgcggatttcgtgcgtcagccccgcaatcgcgtcaaacagcgtgtcgtcgtcgggacgggcggcaaagcgggtgcgcaggcggttgaggatgtggcagaacgcgcgttcggaatcggttgtgccgacggggtggaaaaattcgccctgttcggggaaaaaatcaatcaaatgtccgttgtgggcaaacagccagtagccgccccacatttcacgcataaagggatgggtgttcgccagcgaggtttgtccttgcgatgctttgcggatatgtgcgatgacgttttccgatttgatttggtaggcacgcacgaggtcggcgacgggggaatttacgctcggcttgtcgtcgtggaacaggcgcacgcctttgccttcgaaaaagccgataccgaaaccgtcggcatggtggtcggtaatgccgcccctgcggcggaagccttcaaaggaaaacataatatcggtcggcgtattgcagttcatgcccagcagttgacacatggtttgtcccaatgattcagatggtcgcaagtattcggattataccccgaactgaaaatgccgtctgaaatacggcttgttccccattattccctcgaaaacagaaaacagaaaacaaagacggaaacttaagattccgtcattcccgcgcaggcgggaatccgacttgtccggttttggttgtttttcgttccgtaacttttgagccgtcattcccgcgcaggcgggaatctggaatttcaatgcctcaagaatttatcggaaaaaaccaaaacccttccgccgtcattcccacgaaagtgggaatctagaaatgaaaagcaacgggaacttatcggaaacgaccgaaaccgaacggactggattcccgcttttgcgggaatgacggcgacagggttgctgttatagtggatgaacaaaaaccggtacggcgttgtctcgccttagctcaaagagaacgattctctaaggtgctgaagcacgagtgaatcggttccgtaccatctgtactgtctgcggcttcgtcgccttgtcctgatttttgtgaatccactatagaatttcaatgcctcaagaatttatcggaaaaaaccaaaacccttccgccgtcattcccacaaaagtgggaatctagaaatgaaaagcagcaggaatttatcggaaacgaccgaaaccgaacggaccggattcccgcttttgcgggaatgacgaggttttaagttgctgttttggttttctgttttttgtggaaataacgagattctagggttgcagaaacttctccgaaacaacaaaaacctctccgccgtcattcccacgaaagtgggaatctagaaatgaaaagcaacgggaacttatcggaaacgaccgaaaccgaacggactggattcccgcttttgcggagaaagatgatggaaaatcatcatcgtgcgtcaaacccgcgcggcagcacatcggcagaggaaatcagagatacggttgcagggtgcggcggaggatgtccgtgtcggtaatttcggtgatgttggcttcgcccagccggttcagaccgataaagcgcatgatgccgccgctgacttttttatcgtggctcatgtgttccagccatttttcaaaggcaaacacgggtggcgcggacggcagtccggcggcttcgagcagggcggcgagccgcgcggtatctgcggcggaggttttgcccagttgttcggacaaacgcgccgccaacacgcagccggcggcgatggcttctccatgcagccaagtgccgtaacccatctcggtttcaatggcgtgtccgaaggtgtgtccgaggttgagccatgcgcgtatgccctgttcggtttcgtcttgggcgacgatgtctgccttcatttggcagcagcggtacacggcttgggcgagtttttcccgatcgagcgtcatcagttcgggcatatgctgttccagccattcaaaaaagccgatgtcgccgagcgcgccgtatttgatgacttccgccataccggcggacaattcgcgggcgggcagggtgtgcagcgtgtccaagtcggcaagcaccgcctgcggctggtaaaacgcgccaatcatatttttgccgagcgggtggttgatggcggttttgccgcccaccgatgagtcgacctgactcaacagcgtggtcggtatttgaacgaacggtgcgccgcgctggtaggtggcagcggcaaagccgaccatgtcgccgatcacgccgccgcccagtgcgattaatgtggttttgcgttcggcgcggttttgcatcagcccgtcaaagatgaggttgagcgtctgccagtttttgtgcgcctcgccgtcgggcaggatgatgctgaaatgggatacgcctgccgcatccaatgccgtctgaagcgtgccgaggtagagcggggcgacggtttcgttggcgatgatggcggcgcgtttgcccaaatgcggtttgagcaggcttcctgcctgcggcagcagtccgttgccgataaagatggggtagctgtgggacggggtgtgtacggtcagtgttttcattgttgttccttaaagtttgaaccgccggcccgccgggcggggcgcggtttggttttctgggcgcggcgcatatgccggtttatcgggataagcgtttgagcagggtttgcacggtttcccggcagtttgccgattctacggtaaagtcggcggtttggcggtaaacggggtcgcgtgcggcgtagagttcacgtaatttcgccaaaggatcggcaacttgcagcaaaggacggctgttgtcgcagcgcgtgcgttcgagcagggtttcgggcggggcgtgcagatagacgaccgtgccgcttttgcggataagggcgcggttttcttcttttaacaccgcgccgccgccggtggacaggacgatatggggcaggataaccagctttttgagtatggcggtttcgcgcgaacggaatccctgttcgccttccatttcaaatatggtggggatgggaacgccggcggctgcggcgatttcgtgatcgctgtcgtaaaaacggtaatccagccgctgcgccatttgccggcccagcgtggttttgcccgcgcccatcagtccgatgaggatgagtttgccgttaaagtttttcatcacaattccttaatgtttgacaccccgcctttcggggcgacagggttcgggcttgtcgggttacggcggaattttatacgaaatcggcagggcggcggtacgtttggaaaaataacccgaccatcccgaacctttctgattttaaggacaaataaaagaaatcagggaggttttttatttcaggctgtgttttgacaatccgttgatttcacttatttgtcaggaaaaggcaattatctttgcttaggtaaacaattatccaattgaatatattgaagataatatgtttatcaatactatagtggattaacaaaaaccagtacggcgttgcctcgccttggctcaaagagaacgattctctaaggtgctgaaacaccaagtgaatcggttccgtactatttgtactgtctgcggcttcgtcgccttgtcctgatttttgttaatccactataaagaccgttgggcatctgtcgccgtcattcccgcgcaggcggaaatccgaacacgtccgcacggaaacccatatcccgtcattcccacgaaagtgggaatctagaacgcagggttggagaaaccgttttatccgataagttcctgaaccgacagacctagattcccgcctgcgcgggaatgacggggttttaagttgctgtttcgggttgctgttttttgtggaaatgacgaggctttgggttgtgaggatttaccccttccgccgtcattcccacaaaagtgggaatccagaaatgaaaagcaacaggaatttatcggaaatgaccgaaactgaccgaaactgaacggactggattcccgcctgcgcgggaatgacggcatttcggtcgcggcaaaaagcataaagaaagggcatatgccgtaaaacatatgcccttattttgacgcatcaatagcgcaggctgttgccggccgtacccataatcctcggggtaatgaaaatcagcagttcgcggcggtcggtttttttcccgcgtgttttaaagaggttgccgataacggggatgtcgcccaacagggggactttggtcagcgtattgccgttgtcttcttcataaataccgccgacaatcaatgtgccgccgttttcaaccatagcctgcgtattcaggtttttggtcgaaatacacaggatcgtctgattaccggaggcacattgcgcaggcgagtccttgttgattttgacggtcataatgatttggccgtcgggcgtgatgttcggcgtaacggtcagccccaagacggcttttttgagttccgtgttcgtgctgctgccgccgttcgcgattgaggttacggtgaaaggaatttcgtaaccggattcgattttggcctctttgcggttttgggtcagcacgcgcggattggcaagcgttttggtttttgaaagcgattcggatgcggacaattccaaattcaaggcaccggaggaaatcgcgcgcaccagcgaaatgctgtttgcggcagcggtaatcggcaggttgattttggtttcggccccccatttatcgtcgccgccgaagccggagtttaccccccagccgaatgcgcttgtatcatttttcagctttttcttgcctgtcgcgccgaatttaacgcccaaatcgcgcgagaagccgtctgccgcttcgacgatacgcgcctcaatcatcacttgttgcgcgggtacgtccaattcgtcaatcagtttgcggaatttttcgatgacgctgcgggtgtcggtaacaatcagggtgttggtggcgggatcgatcagcacgctgcccctgccgctgataagcgtgttgcggtttccggtcgtgtcggcattgtccaaacgcaggatgctgcggaattcttccacatttttgtatttcaactggaagttttgggaatacagcgcacccaaatcggcaatgtctttttctgcctgtaagagggctttgtctttggcaagcagctcgtcgcggggcgcgatgttgacgatattcccttgctggcgcatatcgaggttgcgcgcctgcataaccaaatccaaagcctgatcccaaggcacatccttgagggagagggtcattttgccgttgacggagtcgctggcaacaatgttcattccggattcttttgccaaaattgcaggatggtgcggatttcgacatcttggaagtcaagggagatttccggcctgtgaaggttttgggcgcattgttcacgccgcctgactcgaggttttgttttttcggcaggacttggaaggtaaagtatccgggcgcggcggatttgttgacgagttcccagttgccggctgttgtgataatcagctgggtgtcgttattgaggcgtttcagcgtaaccttttgaaccggtgttttaaagtctgccacatccaaactgcgttggagcgtggtcggcagggtatggtttttcagcgtaacgatgatgtggtcgtgctgttggctgatgtcgggctgcccggcaaagcccaatgcagccaattcgataatgccggcatttttgccgtctttgcggaaatcgatattggtttgttttgctggtgctgccgcctgttgttttgctggtgctgccgcctgttgttttgctggtgctgccgcctgttgttttgctgatgccgccgcctgttgttttgccgggctgaacggtgcggatacggatactacggactcggtaaacggtgcggcagcctgttgttttgccggggtaaagggttcggatacggatactgcggacttggtagacggtgcggcagcctgttgttttgccggtgcggcaggcgcggcttttacggcggggcgtgcgggggcggacacggtatcgtccgattcgttaatgaatatccaaactttgttcccgcgtacttcggtattgtattggcccggtttgttcagattcagaaccagacgcgcacggctgctgttttgtgcggcactgattttgctcaacagaggatcggcatattcgagtacctgttgatccatggaaatgccggtttgttcaaagtccaaggcgatgcgggccggtgaggaggttacgaagccggtcgggttgacaatctctttgtcaaagctgactttgacgattttctgtttgttgggcagggaggaaactttgatgtctgtaatgtttcctgccgatgctgtctgaaaggcggcggttgcgacaaagagaccggaaatgatttttgtcagtttggtattcataatggagtaatcctcttcttaattttgttctgcggcaggtgctgccgcttgttcggtgtttttgtcggaagaattcaacagcagttctgctttacgggaaacccagttgcccgtgctgtcttctattagctcgttcaggacgatgctgtcgtcggtaatgctttcgattctaccgtagttttgtcccaaatagttgccgacaccgacagtgtagacataaccttcagcctcgatgaagccggagactttctgtccggacttcaaaatgccgacataacgcatattttccaaactgaatttttccagcgtttctttaatacgcttggtgtcgggggcattttccccttttttgtcggtttccatgcggcggaagtcgaatgcgttcggccctgtaagctgcggcgggctgtataccggcgcaaccggcagggtaggtgcttggaaaggtatgatttctgctttggcttcgcgtcgcgtttgtgccatccattcgtttaggtcctcagaaccttgggaacacgcggagagagccagaaagctgatgagtaaggcatagtgtttcatggtttccctaacgtaagttatttttgctcggcattttgtgccgcttctgcggcaagctcttctacggattttgcttggtaggtggtggcaatggcgctgaggttcaggatgctgctcttgccgtcaggattgccgccgttttccggagattgggcgattttcagcgactcaagggtaatgattcgggagaggctgccgacatcgcgggtaaattggctgatctgttcgtaatttccggtaatggaaatggaatagggtaatcttttgatggggccgtcatctacgggaggttggggcataacgctgtccaagcgcagaccgttgctcgaacctgcctgatgaagctcttgaaccagattgggaatttctgcatctgtcggcagctgtttcaacatgatatcgaaggcagagcggattgaggcaagttcgtccctcaggttgttcaggctggccgcgtcgatacttttctgtttgtaggtgtttttcagttcggtttcttttgcttcgtattcctcaagggattccatctggcttttgaacaatccggcataaccgagccccagcacggcggcaacggccagcagggcgataaaaagcctggcaggaaggttgagcaggtgaaggttgttgagatccaagttggttttagatgatttagaagccattcagtttgcctcctgtgcgtttcccgaagccggattctctttggattcggccgcctttacgatgggttgtaatgttgcctgaagggtaaattcttgatgcgaattgtttttcttgatgcttaacaattcgggttgcttgaatatgccggtattgggcatcgccctcatcatggcggcaacgcggttgtcgctggatgtcctgccgctgagccgataagagtcggcggtaacggcatccagcgaggtcaggtaggtgcttccggggacggcctcattcaggctgtcgaggatttttgcggcttggaggcgtttgagctggagctcctcgattttgtttttcttaatcaggaaggcatctttttcctgtttgagcttttgtatttccgacagctcggtatccaagtgtgcgatggaggtttccagcagcgtgtttctttccgactggttattgatcatattgtcgataaacaggtaggttgccgcaacggcggcaacgcccgtcagcacggcaccgtacatcagcgttttaaactgctgctgtttgcgcttgttcatctcttccctgtaggggaggaggttgattttgattaaattgttcataattataatccccgtaccgccaaaccgaacgccctggtcagtgtcggcgcatcaagttcgaattgttgtttgtctgttttgaggttgtccgcaaaataacgcgcgggatggacgcattgtacatctgcattggtttgtgaggcgacggtttgggcgatgccttcctggcgcgccgcttccccggtcagcaggatatgcttgatgtcggtcatatcgtctgcggtctgcgtggtgtaataaaactgcaagaccctttgtatttcttgggtaatctgctggttgaaatagtttgccacgctttcttggtaatcggaaggtttttgcggggagttgatgatttcttccgctttttcttctgttacctgataggtgcgctggatgagttggttgagctgttcttcgctgacggaggtttcctgtttgtataggatttttccgtcttggatgaccaaggcgtaggtctgtgcggcatatacgccgaaaatggcgactttttcggctgcaagctcgggggcgaaatggtttatccatagcgcgtaggcgttgtattgtccgaaaatgtccacatcaagcgcggataatttcataccggcggcgttgaatgcgtcaatcaggggttcgatttcatcctttctcgatgcgacggccaacacagcttcgccggcggccgattgggacaagacctgatagtcgtaattggcttcttcgagcgatatcgagctgacttcggagatggaggactccacgaacccctgcaggtctaattctgcatctttgtctgtgtaggtcaattgttcgatggttgccaaattttgcgggacggacgcgatgatgtttttgcacgaagtacccagtttggcataggcttgttgcaaatatgtaacaagttgatcgtaattttggactttattgccttgaatgatattctttggtaatttggcaatgacgtatttttccaattgaatttggtttaaactacgtcctgacaattggaccattttgatggaatgctggtcgatatcgatgccgattgccgcgcggttattgagtcccgaagattttttagggagcttggcatctgtttttttagggtttttcaagcttttaaacaagcgcatgatgaaagttcctgctttatttgtacagtgagtaaccgtttcggtatccgtaatggattccttgttctttgcacattgaaaccgtgctttgtagaaatcggttgctattttactttatttaataccaataatggtaaattattattcagctatgattaaaaagattttaacgacttgttttggtttggtttttgggttttgtgtatttggagtgggtttggttgccattgctattttggtaacgtatccgaaactgccgtctttggattctttgcagcattaccagcctaaaatgccgttgactatttattcggcggatggggaagtcatcggtatgtatggggagcagcggcgcgaatttacaaaaatcggcgatttcccagaggtgttgcggaatgcggttatcgccgccgaggataaacgcttttaccggcattggggggtggatgtttggggtgttgcccgcgctgccgtcggcaatgtcgtgtccggcagcgtgcagtcgggtgcgagtacgattacgcagcaggtggcgaaaaatttttatttgagcagtgaaaaaacgttcacacgcaaattcaatgaggtgttgcttgcctataaaatcgagcagtctttaagcaaagacaaaatcctcgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccagaacgtgccaagttgcgccagaagtatattttgaacaatatgctcgaggagaagatgattaccgtgcaacagcgcgatcaggcgttgaatgaggaactgcattacgagcggtttgttcggaaaatcgatcagagtgcgttatatgtggcggaaatggtgcgtcaggaactgtatgagaaatacggtgaagatgcctatacgcagggttttaaggtttataccacggtccgcgccgatcatcagaaggtggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgtgactaaaaagaaaaatgtcgtcatacagctgcccggcggcaggcgggttacgcttgacaggcgcgccttgggttttgcggcccgcgcggtcaataatgaaaaaatgggggaggaccgtatccgcaggggcgcggtcatccgtgtcaaaaacaacggcgggcgttgggcggtggttcaagagccgttgctgcagggggctttggtttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggtcgtccgagctgccggcaagcctgtctatggctttaggtacgggcgagacaacgccgttgaaagtggcggaggcatatagcgtatttgcgaacggcggatatagggtttcttcgcacgtaatcgataagatttatgacagagacggcaggttgcgcgcccaaatgcaacctttggtggctgggcaaaatgcgcctcaggcaatcgatccgcgcaatgcctatattatgtataagattatgcaggatgtggtccgtgttggtacggcaaggggggcagctgcgttgggaagaacggatattgccggtaaaacgggtacgaccaatgacaataaggatgcgtggtttgtcggttttaaccctgatgtggttactgccgtatatatcggcttcgacaaacctaagagtatggggcgtgtcggctacggcggtacgattgcggtgccggtttgggtggactatatgcgttttgcgttgaaaggaaagcagggcaaggggatgaaaatgcctgaaggtgtggtcagcagcaatggcgaatactatatgaaggaacgtatggtaaccgatccgggcttgacgctggacaacagcggtattgcgccgcaaccttcccgacgggcaaaagaagatgacgggggcgcggcagaaggcggacggcaggcggcggatgacgaagtccgccaagatatgcaggaaacgccggtgcttccgagtaatactggttccaaacagcagcagttggattctctgttttaaagactccgcaaaatgccgtctgaaagacttttcagacggcattttagatttggcagtggcaattttttaaatgtttgcggtcggtcaagtggggggaatacggtttccgtataattggggtcagttttcctctggagaggaagcggcggcatctgctgcgtccaaccagcttccgacagttcggttggcctcgtcaataccttgttttttcaggctggaaaacagctgtacgctgatgttttgcctgtcggaataaggtttgagcagttttttgacttgggacagggtttttatctgttcgtttttggataatttgtcggcttttgacagcaggatgtgaaccggtctgccggtcgtgtggaaaaaatccagcatacggatgtcgagttcttttaaaggatggcgggcatccataatcaaaaccagcccgataagctgtttgcgctgttgcagatagtcgccgagcagattgacccaatgtgcgcgtactgcttcggggacttgggcataaccgtagccgggcaaatcgaccataaaattgccgttctgcagctcgaagaagttgatatgctgcgtccgtccgggtgtttttgaaacgtaggcaagacggacatggttggtcagggtattgatggcactggattttccggcattgctcctgccgacaaaggcaatttcgagaggggtgtcgggcaggtctttaaggtggttgatcgtcgtgaagaatttggcgttttgaaaaaggttcatgggcatatccttgttttccgccgccgtttgtccgacagcaaaaatatgcggttggttttatgtgaaacacagtggtaatttaatgtaaatttagtatagaataacacgtttacagaatcatcggttttaatcgggtcaaaaatcccgtatttgaatataaaaagagcattgttgcgttatccaatgctgtaatcaggagcactccatgaaacgattgactttattggcctttgttttggctgccggtgcggtttccgcctctcccaaagcagacgtggaaaaaggcaaacaggttgccgcaacggtttgtgcggcttgccatgcagcagacggtaacagcggcattgcgatgtatccgcgtttggcggcacagcatactgcttacatctatcatcaaactatcggcatccgcgacggtaaacgcacccacggttcggcagctgtgatgaaaccggtggtaatgaatttgagcgatcaggatattttgaacgtatccgcattctatgccaaacagcagcccaaatccggtgaagccaatcctaaggaaaatcccgaattgggtgcgaaaatctatcgcggcggtttgagcgataaaaaagtgccggcgtgtatgtcctgccacggtccgagcggtgcgggtatgccgggaggcggaagcgaaattcaggcttatccgcgtttgggcggtcagcatcaggcatatattgttgaacagatgaatgcctacaagtccggtcagcgtaaaaataccatcatggaagatattgcaaaccgtatgtctgaagaagatttgaaagcggtcgccaactttatccaaggtttgcgttaattccgcaatagtctgttttagaggccgtctgaaaagttttcagacggcttcaggcaattctgcgataagttttttcaatcgcaaccgttggaatcgatgcaggctgtcttcattgtcttgaaataaaaagcatcaagacagtagaatcgggacgttgttttctgtttgcccaattctgctttcccatattcctgatggcggaataaacacacaatgagtaaatcccgtagatctcccccacttctttcccgtccgtggttcgcttttttcagctccatgcgctttgcagtcgctttgctcagtctgctgggtattgcatcggttatcggtacggtgttgcagcaaaaccagccgcagacggattatttggtcaaattcggatcgttttgggcgcagatttttggttttctgggactgtatgacgtctatgcttcggcatggtttgtcgttatcatgatgtttttggtggtttctaccagtttgtgcctgattcgcaatgtgccgccgttctggcgcgaaatgaagtcttttcgggaaaaggttaaagaaaaatctctggcggcgatgcgccattcttcgctgttggatgtaaaaattgcgcccgaggttgccaaacgttatctggaagtacaaggttttcagggaaaaaccattaaccgtgaagacgggtcggttctgattgccgccaaaaaaggcacaatgaacaaatggggctatatctttgcccatgttgctttgattgtcatttgcctgggcgggttgatagacagtaacctgctgttgaaactgggtatgctgaccggtcggattgttccggacaatcaggcggtttatgccaaggatttcaagcccgaaagtattttgggtgcgtccaatctctcatttaggggcaacgtcaatatttccgaggggcagagtgcggatgtggttttcctgaatgccgacaacgggatattggttcaggacttgccttttgaagtcaaactgaaaaaattccatatcgatttttacaatacgggtatgccgcgtgatttcgccagcgatattgaagtgacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgggtgatgcttcgcgcgagcctgtcgtgttgaaggcaacatccatacaccagtttccgttggaaattggcaaacacaaatatcgtcttgagttcgatcagttcacttctatgaatgtggaggacatgagcgagggcgcggaacgggaaaaaagcctgaaatccacgctgaacgatgtccgcgccgttactcaggaaggtaaaaaatacaccaatatcggcccttccattgtttaccgtatccgtgatgcggcagggcaggcggtcgaatataaaaactatatgctgccggttttgcaggaacaggattatttttggattaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaaggcgcacctgccgaaatccgcgaacaattcatgctggctgcggaaaacacgctgaacatctttgcacaaaaaggctatttgggattggacgaatttattacgtccaatatcccgaaagagcagcaggataagatgcagggctatttctacgaaatgctttacggcgtgatgaacgctgctttggatgaaaccatacgccggtacggcttgcccgaatggcagcaggatgaagcgcggaatcgtttcctgctgcacagtatggatgcgtacacgggtttgaccgaatatcccgcgcctatgctgctgcaacttgatgggttttccgaggtgcgttcgtcgggtttgcagatgacccgttccccgggtgcgcttttggtctatctcggctcggtgctgttggtattgggtacggtattgatgttttatgtgcgcgaaaaacgggcgtgggtattgttttcagacggcaaaatccgttttgccatgtcttcggcccgcagcgaacgggatttgcagaaggaatttccaaaacacgtcgagagtctgcaacggctcggcaaggacttgaatcatgactgaacactataaaacccttccggaacacgagctgctgattcagaagtctttgatcagcaatctgaatctttgggattgggtatttgccgtgctggtttttgcggctacggttttcgtacagacccgttccggtatgcatatggacatttacgaaacggtcatgttgtgggcaagtgccggtattgccgtgtttttgggttggtttttcaaaccgatgcgctggtttgttcctttaagcgtattgcttgcctatgccgccgtcggtttgtacggaggcgacatcaaatcggcagagattttcctgttgcggtatttcctcagcagccagtcggcgatcatgtggcagtgcgcctttgtctttttcgccctgttcgcctatatttcgggcgcggttttggcaagcgtaaaaaatgtgccgaccaacacgctgttgggtatgggaaccgtgtttgcatgggtgtctgccgtagcaggctttaccggtctgctggtacgttggcacgaaagctatctgctccgtcccgatgcggggcatattccggtttccaacctgtatgaagtgttcatcctgtttttggtgattaccgcgctgatgtatctttattatgaaggtaagttcgccatacagaaattgggcggcttcgtgttcggctttatggcggtcgtggttggatttgtcttgtggtacagcgtgtcccgcgaggcgcataccatccagccgctgattcccgcgctccagtcctggtggatgaaaatccacgttccggcaaactttatcggttacggcgcgttttgcatttccgcgatgctcggtattgccgaactggtttccctgcgtgcggaaggaaaaggcggaaaactgtggctgccgccgtcggcattgatcgacgaggtgatgtataaggcgattgccgtcggctttctgttctttaccattgccaccattttgggtgcgctgtgggcggcagatgcttggggacgctattggagttgggatccgaaagagacgtgggcgttcatcgtctggctcaattacgccgtttggctgcacttgcggctggttgccggttggcgcggcaaagtgctggcgtggtgggcgattatcggtttgttcgtaaccgcatttgcctttatcggcgtgaatatgtttttgagcgggctgcattcttacggaacgctttgatacggtgcgacgatgccgtctgaacggtcttcagacggcatgttccgtttttgggatacggcagtcgtgccgaaatccgctaaaatacgtttttcagtttttaacggcatcagaccatgttggtattaggaatcgagtcttcttgcgacgaaacaggtgttgcgctttacgatacggaacgtggattgcgggcgcactgcctgcacactcaaatggcaatgcacgccgaatacggcggggttgtgccggaattggcaagccgcgaccatatccgccgccttgttccgttgacggaaggctgtctggcgcaggcaggcgcatcgtatggcgacattgacgcggttgcctttacgcaggggcccggtttgggcggcgcgctgctggcgggttcgagctacgccaacgcgctggctttagcgttggacaagcctgttattcccgtccatcatttggaaggacatctgctgtcgccgctgttggcggaggaaaaacccgactttccttttgtcgcgctgttggtttcgggcgggcatacgcagattatggcggtcaggggcataggcgactacgcgcttttgggcgagagcgtcgatgatgcggcgggcgaggcattcgacaaaacggcgaaactgctgggcttgctgtatccgggcggtgcgaaactgtcggaacttgcggaatcgggcaggttcgaagcgtttgtttttccgcgcccgatgattcattccgacgatttgcagatgagtttttcaggtttgaaaaccgccgtattgaccgccgtcgagaaagtgcgcgcggaaaacggggcggatgacattcctgagcagacacgcaacgacatctgccgtgcgtttcaagatgcggtagtcgatgtgttggcggcgaaagtgaaaaaagccctgttgcagacagggttcagaaccgtagtggtcgccggcggggtcggtgcaaaccgcaagctccgtgaaactttcggcaacatgacggtgcaaatcccgacccccaaaggcaagccgaaacatccgtccgaaaaagtcagcgtgtttttcccgccgacggcatactgcacggacaacggtgccatgattgcctttgccggtgcgatgcacctgggcaagggcagggaggtcggtgcgttcaatgtccgtccgcgctggccgctgtcggaaatcgtcagatgacaaaatgccgtctgaaattgttcagacggcatttttattttcgttacggcattttgtagcggttgtacataaacagatactgcgtcggaaaacggcgtatccaatattcggcattgcggttgaacacggcggcatcatgggctttgtcgccgttcaattccccttggacggggcggatgtgcaaatcgaaaccttgtccgccaggcaggcgttcgcagcagaaaaacagggttttcacgcctttgacgtgtgccaattttgccgccagcgtcatggtataggcaggtttgccgaagaaatccacccatacgccttccccgccttcttgaggggaggggacgtggtcgggcaggacgatggttgcttcgcccgaacgcagggctttgatgatttgtttgaccccttgtatgctggtaggcgcggtttttcctttgccgcgaaccctgcccgcctgcatgattttgtctatcgctttgattttcggcggtttgtacatggcggtcagcgggaacggaagctgctggctgatgtagcgtccgcccaaatcgtagctgccgatgtgcggcgtgatgaatagcagcccttcgtgtttgtccaaagcctgctgcacatgttcccagccgtgtaccgctttgaacattgtttctatgtcttccggttttctgaaaaacgcgggggcaagttccaaaccgccttttgccgtttccgcaaaaacggctttgaccgttttggggtcggggttcaaacccgcctgccgcatattggcgacgatgcgcgcgcggtcttcctttaaaaggtaaaacgccagatgtccgagccggtttcccagcgtgtgcagacaggaaagcggcagcagggagaggcatttgagcagggcggtcaacaggatgtgcatggcggttcgcaaagggggaaacagcctgaattgtaaacgaaacatgccgtctgaaaaagggaagtattgcggcaatatgccttttctgctacgatgcgtgctgcattaagagttgggaattccatgccaacctgcttttcaaaaggaaaagtaaggtggacggttgaaaagccgatgtggctcaccagagcaatccaaacccgcttgatgcgggaatttttttgcctgtaagaaacgtacgggcagagattccaaagtgctattcaaatgggaatatttctcaactgaatggtatgaatagggaaattttgctatatttcccgctgtcgacattatgttcatacaacatgccgtctgaagaagatggtttgtttttcaaggaaaatctcaatgagcgaatatctgtttacttccgaatcggtatccgaaggccatccggataaagttgccgaccaagtatccgatgcgattttggatgccatcttggcgcaagacccaaaagcacgtgtcgccgcagaaaccttggtcaacacaggcttgtgcgtattggcaggcgaaattaccaccaccgcccaagtagactacatcaaagtcgcacgcgaaaccatcaaacgcatcggctacaactcctccgagctgggctttgatgccaacggctgcgcagtcggcgtgtactacgaccagcaatcccccgacatcgcccaaggcgtgaacgaaggcgaaggcatcgacttgaaccagggcgcgggcgaccaaggtttgatgttcggctatgcctgtgacgaaacccctaccctgatgccgtttgccatctattacagccaccgcctgatgcagcgtcaaagcgaattgcgcaaagacggccgcctgccttggctgcgtcctgatgccaaagcccaactgaccgtggtttacgacagcgaaaccggcaaagtaaaacgcatcgacaccgtcgtcctgtctacccagcacgatccgtccatcgcttacgaagagctgaaaaacgccgtaatcgaacacatcatcaaaccggttctgccgtctgaactgctgaccgacgaaaccaaatacctgatcaacccgaccggccgcttcgttatcggcggcccgcaaggcgactgcggtttgaccggccgtaaaatcatcgtcgatacctacggcggcgcggctccgcacggcggcggcgcattctccggcaaagacccgtccaaagtggaccgttccgccgcttacgcctgccgctatgtcgcaaaaaacatcgtcgccgcaggtttggcaacccaatgccaaatccaagtttcctacgccatcggcgttgccgaaccgacttcgatttccatcgatactttcggcaccggcaaaatcagcgaagaaaaactgattgccttagttcgcgaacatttcgacctgcgccccaaaggcatcgtccaaatgctcgatctcttgcgcccgatttacagtaaatccgccgcttacggacatttcggccgcgaagaacctgagttcacttgggagcgcaccgacaaagctgctgcattgagggcggcagcggggctgtaattccggtttgaaaatcaaaaatgccgtctgaacagttcagacggcatttttatatagtggattaacaaaaatcaggacaaggcgacgaagccgcagacagtacagatagtacggaaccgattcacttggtgcttcagcaccttagagaatcgttctctttgagctaaggtgaggcaacgccgtactggtttaaatttggggctgtcctagataactagggaaattcaaattaagttagagttgcccctatgagaaaaagtcgtctaagccggtataaacaaaataaactcattgaactgtttgtcgcaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagtattgtttatacggattgttatcgtagctatgatgtattagatgtgcgcgaatttagccattttagcttcgctgaaacttcgttttcgtatcaatcacagcacacattttgccgaacgacaaaaccatattaatggaattgagaacttttggaatcaggcaaaacgtcatttacgcaagtttaacggcattcccaaagcgcattttgagctgtatttaaaggagtgcgaatggcgttttaacaacagtgagataaaagttcttgttccattttaaaacaattagtaaaatcgagtttgtcctagttatctaggacagccccttaaatttaatccactatattttcctgtttcaggctcggcgttctttgcacatcagtttcgcatccagccagccatcgccgccggagatgatgttgttggcaacgaagttgtccaagtctggcagcagggaaacggcgcggccgctgttgatgatgacgaccaccgccatcggtttgtcgcccagccaataacctgcaagggcgcggacattgttgagcgtgccggtttttaagcgcaacagcccgccgctttgtttgaagcggttgcgtaaagttccgtctgtgccggcgatgggtagcgtgtcgatgaaatcttgtgcaaacgggctgaaataagccgtttccaacatttgcgccatcattctcgccgttaccctttcttttctggacaggcccgaaccgttttccaaaaccaaatccgcaacatcgatgcccgatacggcaagttcgcgccggacggcagacgccgcctgttcggaaacggcgggcagtttgccgtcgccgccgagtttgaggaagacggaacgcgcaattagattgtccgaacgcttgttcatgtccgtcaaaatttctttcatcggtttggcgtgtgcaacggcaagtgtctgcgcgccttccggcgtgtcggctatgccgataccgtctgaaatccgtccgccgccgagcagccagtggttggtaaaactttgccggatcagttcgtcaagcgcgaacatccggacaccgacaggcttgcccaaacagctctcgggaatattgccgcgcaatttcagcgtattgtccgaaaaagatgcacgcatcagttttttgatcgaagggcaggcagcttgggaggcggtaattttcaagttgttttgggcgaaaatatgcggcaaaggcggatcggtgaggatgtcggtactgccggcggcattgcgttcggcgcgcaccataaccataccggcagacagcatagttggattggggggcgtcataaacggcgaaccgctgtcggcttcgaaatcgtcggggctgccgacttcgccccacaggctgtggtcgagcatcaggtgtcccgtgatattgagtatgccttgttcgcgcaactgtttttgagcatcaagcaggttttcctgattgaaaacggggtcgccgctgcccgcccaatataggtttccgtcaagcgtgccgtcgtttaccgtaccgttgctyytaaacycggtcgcccagcggtaattgctgccgaaggttttgaaggcggcaaacgcggtaacgagtttcattgtggaggcggggttgacggggacatccgagcggtggtcaatgatgacttttccgctgtcaagctcttggacatatacggcgatttcgttttgcggaatgcggccggtatcgagcgc

SEQ ID NO: 37790 - DNA, 26778 bp, Neisseria meningitidis
  misc_feature (25318)..(25318): N is any nucleotide
ggcggcgttgaggccgacggcgacggttttgccgttgtctttgcggcgcagggtcagtgtgccgttgatttcgcctacaccaaaggataagaggtggcggcgggcaaagcgtccctgcattccgatgccgccaaagccggtttcgggggctgcgccggtgaggagttggacgacggacgcggttacgccgaccgtgccttcgtcgcgcgcgccctgcataaaggcttcgatgccgccgcgttcgggcagctcttcgccgtaaagtgctttcagacctttgataaccatcaggtacgcgcccgcgacggtcgggcaggaatgtccgcacaggcgcacggcatcggcgtagcggtaagtgaggatgccgttttcggccgcgccgaggaattcggccaatgcgtcttggacggtaatggtcggggcttggttgaagaatgatgggaaatgttcttgtgtcatatggtttgtcctttcggggcggcggccgttcagacggcatccgtcattttttgtgttttaaaacgagatagaggaaaacgagtccgccggcaaattctactactacgctcaacactgcctgcataccgagcaggtgttcgaacacggtctgtccgccgaccaagaggatgccgccgatacaaaccgtcatcggcaggcggacggaatgtttgaccgacggggaaaagtggttggcaagcgaggcggcgagaagcccgaaaaagcttacggggccgaccacggcggtcgccgtcgccaccaatgcggcaatccaaagcagtatccataaggtgttgcgcgtgtagctgatgcccaaattgacggcttggtcacgccccaaaaggtaaacgtccaagcggtagcgttcgcgccaaacgaccgccgcgctgacgagcagaatcagcgcgcctatgcccaaaagctcgctgtggacggtattgaatccggcaaacatattcgcctgcgcggcggtaaattcttcgggatcgatcatgcgcgaaagcagcgacgacaggctgcggaacaaaatcccgaaaatcacgccgattaaaatcatgcgcgacaaatcgcgtccgccctgtttgatgagcgtgtagaacagcagcagcgagccgcccatcatgacgaccagttcaaagccgaatttgcccgtcaacggcagggaagcatagcccacgccgccgaacgtaaacaccagcaaggtctgcaaaaacacatacagcgaatcgaaacccaaaattgaaggggtcagaatcggattattggtcagcgtttggaagagttgcgtggacacgccgaccgcataggcgaccatcagcagcgcggcaagtttggtcagccgcagttgcaaaacaaaatcccaatcgcctttgacgttgagcgtcataaacaggacgcaggaaaccagcaacagcgcaaaggcgacccacaacgggcggctgcttcctgccataaaaccgatatttttttcagacggcataggcgggtttcctcaacaaaagccacaaaaacaaagccgtacccaatacaccaaaaaccgtagagaccggaatttcaaacggaaacacaatcacgcgtccgataatgtcgcacagcaacaccaaagatgcgcccagcaaggccaccgcaggcaggctttggcgcaacctgtcgcccatcaggcggctgatgatgttcggcacgaccagcccgataaacggaatattgccgaccgtaacgataaccagcgacgtaatcaaagccacaataatcaaacccgaccacaacaccgccgtccggttcaaacccaaattcacgcttaccgtttcgcccagccccaaaatcgtcagccggtcggcaatcagataggcaaacaccgccaaaccgcccgtaatccaaagcagctcgtaccgccccagcagcacgctcgaaaaatcgccctgctgccacacgccgagcatttgcagcatttcgttttcatacgcgataaaggtggctaccgcctcaatcacaccgccgaaaataatcccgaccaaaggcaccatcagttgcgcggtcggcggcaggcggcggatcagcagcataaagaccaacatcccgatcagcgcggcaacggcggcaaccgacattttcgccggcagcggcgcggccggcagcagcagggtcatcagcagcaaacctaaagccgcgctttggcttgcgcccaccatcgacggttcgacaaaacggttgcgcatcaaaatctgcataatcatgccggccaccgccatcgacgcgcccgtcagcacaatcgcaaacgtgcgcggcaggcggctgatgaacatgacctgctggctgtcggacagtgaaaacacatcagaccagcggaaatcggcaacgcccaccgacaggctgacggcaaacaacaccgccagcagcagcaggttggtcaggttgagggaaaaaggtttggcagtcataaacagaagggaaaagcgttaaggcgtagaagattcaaacaaggcagtccgaaccgtcggagcggaaagccttgtttgaagcctccgtatcgggcaatgccgtctgaaacacaggaggcggtttgcatccgtgtttcagacggcatcgaatgccgccgtttcattattttgccgcgttaaaagcgtcggcaacctgtttgcttgcattcagcagctcttgcgcgccaccggctgccaaataagtttcaggaacgaggtacacgacctgtccttttttccaagcggttgtttcggcaaccagcggattatccaacacgtctttcgccgcctgaccctcttcgccgatggccgcgcttcggtcaaggacaaacagccagtcgggatttttctctttcaggtattcaaagctgataggctgaccgtggctgccttctttaattgattcatcgacagcgggaacgccgatgtctttgtgcagccagccgcccaagcgtgaagacgggccgaaagccgacatcttgccgccgttgaccaaaatcaccaaacctttgcccttaccttgtgcggcagttttcgcggcttcaaaagacgcgtcgatttccgccttcagcttgtcggcttccgcctgtttgccgaagatttgcgccagcgcgtcgatgcgctctttggcactttctttgaggttggcggtatcggcggtcatttcgatggtcggcgcgatttcgttcaatttgtcaaacgccttggcggcgcggctgccgatgatgatgagctgcggtttgtaagcgttgagcgtttcgtaatccggctcgaacaaagtgccggcaggttttgtcgttttgaaatattcctctaaatacggcaggcggtttttatcgacggacaaaccggttttcacgcccagtttgctcaaggtgtcgagcatacccaaatcgtaaacggcgatgcgttcggggttttgcggtatttgaacgtcgccgcgcgcggttttgacggtaacggacgcgccttcggtttgtgcggcggaaaccgcctgttctttggcttgtggggcagagtcggaattttgcggcgaacacgcgcccaaagcgagggcggtgcatacggctaaagcagtcaaacgtaacataggtgtctccaaaatggggatattggggcaaagccgccggtcggacaaaccggaacggctttagaaaggataaatgataatctatagtggattaacaaaaatcaggacaaggcgacgaagccgcagacagtacaaatagtacggaactgattcacttggtgcttcagcaccttagagaatcgttctctttgagctaaggcgaggcaacgccgtactggtttttgttaatccgctatattccgccatctctaagatttacagcgatacacgggtaatttaaggaatgcccgaaccgtcattcccatcacttttcgtcattcccatcacttttcgtcattcccaccacttttcgtcattcccgcaacctttcgtcattcccgcgaaagcgggaatctagaatctcggactttcagataatctttgaatattgctgttgttctaaggtctagattcccgcctgcgcgggaatgacggctgcagatgcccgacggtctttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatatatcaaattatcagaacagatgccgtctgaaaggctttcagacggcattttttcgggatgtgcgttttagaacttgtagttcacgcccaagcgtacatcacgtcccacgcccggcagggtattggtccatcgttggctgtgcggatagtagaacgtgttgaacacgttgttaaccgaaagattaacattgagcgtgtctttgcccagcggtttccagttggcgaagacatcgttcacaccgaaacctttgcgtacaacgttttccaatttgccgttgcggtctttttgacctgccaccaatatcgaacccacggctttttgaacataacggccgcgccagccgatttccagattcgggttttggaagcggtaggcaagggaagccgtccaagtgcggccgacttgtgcgccaaattcaggattcgcgctcaacagcttgtctttgtgcgtatcgtaaaagcgcggtttgctgtggcttacgccgactttggcagtcaggccgccggtgcggtaggacgcgcccaattcgtaaccgtggtttttgatgtaaccggcattgacggcttcacggacggcgacagagtcgtggcggttttgcggattggcaagcgcgtctttgatggtctgccagaagtagctgccgtttgcggcaaacgtgccgtcgttgtagttgaagccgatttcggtattgcgcgcgcgttcggctttcgtgccgtcggcaatcgagatgatgccgcgtttgccgtgggtttgcagcgcgtcatacaggcgcgggctgcggctggcgtagttgtggctcgcgctgaagctccagtgttcgtgcggctgccaaatcacgccgaaactcgggttaaggttgttgcttgaaacggttttgccgtcgtgggttttcaccttgaagcggtcgtaacgcagcccgccggtcagggtaaagccgtcaatctcgtgaatggcttcgatatacgcgccggtatcggttttggtcgggttggtcagacggtaggctttggcaattttttcattttcacggttcttatttttctcttcatcagttgctttttctttatcttcaattttaaattgtgaattcaaaaacgcttgcggtttgatttcctgatggcggtagttgataccgtatttcagcagggtttgttcggcaaggcggctgtcgaagttgaagttcataccccgagtggtgatttgggtatggttggggccttttacattgcctgcgtaaccggtgccgctgtcatcggcggaatagcgttctttttccaacacataggcgttggcatccagtttttcgacaaagcccaggtttttacccgtgtacgccaaattggtgttggattgtgtggtttcgcggtaagcaggggcttggcgttccatacttattcgctctttatcgccgccgacggtaaattcttcacggacggtacggatgccccggtgctggtctttcatatggctcaatacgatgcggtggtcgccgtcgccgaagcttgttccgattttggcgaggtagctgcgtttgtccagcgcgctgtacggtacggttttgccgccgttgaaattattacggaagcctttacctgcttcgtaatctttttcattgttgcggttgtaagagaacaagccgtcgaagttgccctctttcccgaatacgcttgcgccgtagcttacgccttcgttgctggcaaagccgctgttgaggcgcacgccccagtttttatccaagcctttgagcaggtcttgggcatcgacggttttggtgatgatcgcgccgttggtcgcgccgataccggcagaggcggaacccgcgcctttttgtacggaaacgactttaaccaaagcgggatcgacaataaatctgccttggtggtaaaggatttggctgtcggaataggcgttgtccaccttgatgtcgacagagttttgacccatgccgcgcagcgtcaggaattgggacgtgccgttgccgccgccgaaatcgatggagggctcttcttttaagagttcgcgcatatcggttgcggtgctttcgtctttttgttgcagcgtaacgatgttggtacggattttgctgccttggcggtcgccttttacggtaacggtatccagtacgaccttggcattattttctgccgcatgggcaaaacctgccgccagggtaagcgagagcaggctgagacggaacaatggggtattcattcaatcgtcctcttgagtatgaagggaagtaaatccaaaccgttaagatttggcaggataagaaaaataattaataattatttttatttatattaacagggggggggggatttttgcaaagctgattatcgtttttatttgcgaagtgttgttttttgttgacaggttttgtcggaaatgtaaaaaaacggcgggaatatagtggattaacaaatgcgggaatgacgaagcctgcgcgggaatgacgaagcctgtgcgggaatgacggcggagcggtttctgttttttccgataaattcctaaaacttaaaatttcatcattcccgcaaggacagaaaaccaaaaacagaaacctaaaattcgtcattcccacgaaagtgggaatctagaatcccggactttcagataatctttgaatattgctgttgttctaaggtctagattcccgcctgcgcgggaatgacgatatttctgtttttgattttttgtttttggggaatgacgggatttgagattgcgggcatttatcgggtaaaacggaaattatgcgttacgaaaatttatccgaaatcacggcaacttttccaccgtcattcccacgaaagtgggaatccaggtctgtcggcacggaaacttatcgagaaaaacggtttctttatagtggattaacaaaaatcaggacaaggcgacgaagccgcagacagtacggatagtacggaaccgactcactcggtgcttcagcaccttagagaatcgttctcttcgagctaagtcaaggcaacgctgtactggtttttgttaatccactatagattttacgtcctggattcccgcctgcgcgggaatgacgaatttcaattttctgtttttgattttttgtttttacaggaatgacggtcttttcatatcgaaaaaagttgccgtaccgcaccgataatttccgcctgcgcggaatgaagattcaagcgttgcccgaaattcaaaaaaactatagtggattaacaaaaaccagtacggcgttgcctcgccttagctcaaagagaacgattctctaaggtgctcaagcaccaagtgaatcggttccgtactatttgtactgtctgcggcttcgtcgccttgtcctgatttttgttaatccactataaaaccaaacggatcggattcccgtttttatgggataacggaatgttcagccggacaccaccacgatgctttcgatccgtttattttccgatacaaaacctcgaaaaaatcacgccgagcaggtcgtccgccgtaaactcgcccgtgatttcgccgcatgcgacctgcgccaagcgcaagtgttcggcaaacagctcgatttgatggttgccgcacaatgccgccagcgacaattcttcctgcgctgctttgagtgcgttgacgtgccgcgtccgcgccaaaaacaacccttcgctttcgccctgccaaccggcctcgcgcaacaacgtccgtttcagcgcgtccaagccgtcgccggttttcgccgacaacgcgatgacggtttccgcgcccgtaccgaacccgcctgccgcgtgtgcgtgcaaatcggatttgctgtggatttcgatgcgtttcaactccggcggcaacgcgtccaaaatcgcccgtgtcttttcattcaaaccctcgcgcggatcgaccaacaccagcgcgacatcggcttcggatacggctttgcggctgcgttcgatgccgatacgctcgaccacgtcgtccgtctcgcgcaaacctgccgtatcgacaatatgcaccggcacgccgtcaatcaggatacgttccctgaccgcgtcgcgcgtcgttccggcaatatcggtaacaatcgccacttcgtcgcccgccaacgcgttcagcaggctggacttgcccacattcggcgcgccgaccaatacgacattcagaccttcgcgcaaaatcgcgccctgctgcgcgttggcaagcacatcatccacggcgcggcgcaagccgtccagtttgccgcgtgcgtctgccgcttcgagaaaatcaatgtcttcctcgggaaaatctaacgtcgcttcgaccagcatccgcaaggtaatcaagtcttcgaccagaccgtgtatccgccgcgaaaaatcgcccttgagcgagcgcaaagccagacgcgccgccgaacggctggatgcgtcaatcaaatccgccacgccttccgcctgtgccaagtccagtttgtcgttcaaaaacgcacgcttcgtaaactcgcccggttcggcaaggcgcgcgcccaattccaaacagcggttcagcagcatatccatcaccaccggcccgccgtgtccctgaagctcgatgacatcttcacccgtaaaacttgccggtgcggcaaaaaacagcaaaagcccgctgtcgattgcctgtccgtccgtgtccgtaaaatcagcataggttgcggtacgcggcttgggcgttttcccgcacaaagcctgcgccatcggcagcaggtttttccccgatatgcgtatcacgcccacgccgccgcgccctggtgcggtagcgactgccgcaatcgttggaacgttatccgacataaaacccccgaaaattcaaaacagccgcgattatagcaaatgccgtctgaagtccgacggtttggctttcagacggtataaaaccgcaaaaatgcttgataaatccgtccgcctgacctaatatataaccatatgaaaaaacgaaacacatacgccctcctgctcggtataggctcgctgctgggtctgttccatcccgcaaaaaccgccatccgccccaatcccgccgacgatctcaaaaacatcggcggcgattttcaacgcgccatagagaaagcgcgaaaatgaccgaaaacgcacaggacaaggcgcggcaggctgtcgaaaccgtcgtcaaatccccggagcttgtcgagcaaatcctgtccgacgagtacgtgcaaataatgatagcccggtgtttccattcgggaccgttgccgccgccgtccgacttggcgcaatacaacgacattatcagcaacggggcagaccgcattatggcaatggcggaaaaagaacaagccgtccggcacgaaaccatacggcaagaccaaaccttcaacaggcgcgggcaactgtacggcttcatcagcgccatcctgatactgctttttgccgtcttcctcgtatggagcggctaccccgcaaccgccgcctcccttgccggcggcacagtgtttgccttggcgggtgctttcgtgattggaagaagccgagaccaaggcaaaaattaatgacaaatcctagggcgtgcttcatatccgcccgaacgccgaaccgcacatataggcacatcccgcgcgccgcccggaagcggaagccgcgccctcccaaacaaacccgaatcccgtcagataaggaaaaataatgaaaacaaccgacaaacggacaaccgaaacacaccgcaaagccccgaaaaccggccgcatccgcttctcgcctgcttacttagccatatgcctgtcgttcggcattcttccccaagcctgggcgggacacacttatttcggcatcaactaccaatactatcgcgactttgccgaaaataaaggcaagtttgcagtcggggcgaaagatattgaggtttacaacaaaaaaggggagttggtcggcaaatcaatgacaaaagccccgatgattgatttttctgtggtgtcgcgtaacggcgtggcggcattggtgggcgatcaatatattgtgagcgtggcacataacggcggctataacaacgttgattttggtgcggaaggaagaaatcccgatcaacatcgttttacttataaaattgtgaaacggaataattataaagcagggactaaaggccatccttatggcggcgattatcatatgccgcgtttgcataaatttgtcacagatgcagaacctgttgaaatgaccagttatatggatgggcggaaatatatcgatcaaaataattaccctgaccgtgttcgtattggggcaggcaggcaatattggcgatctgatgaagatgagcccaataaccgcgaaagttcatatcatattgcaagtgcgtattcttggctcgttggtggcaatacctttgcacaaaatggatcaggtggtggcacagtcaacttaggtagtgaaaaaattaaacatagcccatatggttttttaccaacaggaggctcatttggcgacagtggctcaccaatgtttatctatgatgcccaaaagcaaaagtggttaattaatggggtattgcaaacgggcaacccctatataggaaaaagcaatggcttccagctggttcgtaaagattggttctatgatgaaatctttgctggagatacccattcagtattctacgaaccacgtcaaaatgggaaatactcttttaacgacgataataatggcacaggaaaaatcaatgccaaacatgaacacaattctctgcctaatagattaaaaacacgaaccgttcaattgtttaatgtttctttatccgagacagcaagagaacctgtttatcatgctgcaggtggtgtcaacagttatcgacccagactgaataatggagaaaatatttcctttattgacgaaggaaaaggcgaattgatacttaccagcaacatcaatcaaggtgctggaggattatatttccaaggagattttacggtctcgcctgaaaataacgaaacttggcaaggcgcgggcgttcatatcagtgaagacagtaccgttacttggaaagtaaacggcgtggcaaacgaccgcctgtccaaaatcggcaaaggcacgctgcacgttcaagccaaaggggaaaaccaaggctcgatcagcgtgggcgacggtacagtcattttggatcagcaggcagacgataaaggcaaaaaacaagcctttagtgaaatcggcttggtcagcggcaggggtacggtgcaactgaatgccgataatcagttcaaccccgacaaactctatttcggctttcgcggcggacgtttggatttaaacgggcattcgctttcgttccaccgtattcaaaataccgatgaaggggcgatgattgtcaaccacaatcaagacaaagaatccaccgttaccattacaggcaataaagatattgctacaaccggcaataacaacagcttggatagcaaaaaagaaattgcctacaacggttggtttggcgagaaagatacgaccaaaacgaacgggcggctcaaccttgtttaccagcccgccgcagaagaccgcaccctgctgctttccggcggaacaaatttaaacggcaacatcacgcaaacaaacggcaaactgtttttcagcggcagaccaacaccgcacgcctacaatcatttaaacgaccattggtcgcaaaaagagggcattcctcgcggggaaatcgtgtgggacaacgactggatcaaccgcacatttaaagcggaaaacttccaaattaaaggcggacaggcggtggtttcccgcaatgttgccaaagtgaaaggcgattggcatttgagcaatcacgcccaagcagtttttggtgtcgcaccgcatcaaagccacacaatctgtacacgttcggactggacgggtctgacaaattgtgtcgaaaaaaccattaccgacgataaagtgattgcttcattgactaagaccgacatcagcggcaatgtcgatcttgccgatcacgctcatttaaatctcacagggcttgccacactcaacggcaatcttagtgcaaatggcgatacacgttatacagtcagccacaacgccacccaaaacggcaaccttagcctcgtgggcaatgcccaagcaacatttaatcaagccacattaaacggcaacacatcggcttcgggcaatgcttcatttaatctaagcgaccacgccgtacaaaacggcagtctgacgctttccggcaacgctaaggcaaacgtaagccattccgcactcaacggtaatgtctccctagccgataaggcagtattccattttgaaagcagccgctttaccggacaaatcagcggcggcaaggatacggcattacacttaaaagacagcgaatggacgctgccgtcaggcacggaattaggcaatttaaaccttgacaacgccaccattacactcaattccgcctatcgccacgatgcggcaggggcgcaaaccggcagtgcgacagatgcgccgcgccgccgttcgcgccgttcgcgccgttccctattatccgttacaccgccaacttcggtagaatcccgtttcaacacgctgacggtaaacggcaaattgaacggtcagggaacattccgctttatgtcggaactcttcggctaccgcagcgacaaattgaagctggcggaaagttccgaaggcacttacaccttggcggtcaacaataccggcaacgaacctgcaagcctcgaacaattgacggtagtggaaggaaaagacaacaaaccgctgtccgaaaaccttaatttcaccctgcaaaacgaacacgtcgatgccggcgcgtggcgttaccaactcatccgcaaagacggcgagttccgcctgcataatccggtcaaagaacaagagctttccgacaaactcggcaaggcagaagccaaaaaacaggcggaaaaagacaacgcgcaaagccttgacgcgctgattgcggccgggcgcgatgccgtcgaaaagacagaaagcgttgccgaaccggcccggcaggcaggcggggaaaatgtcggcattatgcaggcggaggaagagaaaaaacgggtgcaggcggataaagacaccgccttggcgaaacagcgcgaagcggaaacccggccggctaccaccgccttcccccgcgcccgccgcgcccgccgggatttgccgcaactgcaaccccaaccgcagccccaaccgcagcgcgacctgatcagccgttatgccaatagcggtttgagtgaattttccgccacgctcaacagcgttttcgccgtacaggacgaattagaccgcgtatttgccgaagaccgccgcaacgccgtttggacaagcggcatccgggacaccaaacactaccgttcgcaagatttccgcgcctaccgccaacaaaccgacctgcgccaaatcggtatgcagaaaaacctcggcagcgggcgcgtcggcatcctgttttcgcacaaccggaccgaaaacaccttcgacgacggcatcggcaactcggcacggcttgcccacggcgccgttttcgggcaatacggcatcgacaggttctacatcggcatcagcgcgggcgcgggttttagcagcggcagcctttcagacggcatcggaggcaaaatccgccgccgcgtgctgcattacggcattcaggcacgataccgcgccggtttcggcggattcggcatcgaaccgcacatcggcgcaacgcgctatttcgtccaaaaagcggattaccgctacgaaaacgtcaatatcgccacccccggccttgcattcaaccgctaccgcgcgggcattaaggcagattattcattcaaaccggcgcaacacatttccatcacgccttatttgagcctgtcctataccgatgccgcttcgggcaaagtccgaacacgcgtcaataccgccgtattggctcaggatttcggcaaaacccgcagtgcggaatggggcgtaaacgccgaaatcaaaggtttcacgctgtccctccacgctgccgccgccaaaggcccgcaactggaagcgcaacacagcgcgggcatcaaattaggctaccgctggtaaccgccggatatgccgaaaggggtctgacgatgccaccgtgcgctgtcaaaccctttttctgccgccgccttgtgcctgctccattgtctgataaccgtcaaattgatttttagcccatgtttggtgggtcggggaaatctatatcttcgtccgtgccgaaatagtctgagacctttgcaaaattcctttccctcccgacagccgaaacccaaacacaggttttcgtctattttcgccccaaatacctcctaattctacccaaatacccccttaatcctccacggacacccgataatcaggcatccgggctgctttttaggcggcagcgggcgcacttagcctgttggccgctttcaaaaggttcaaacacatcgccttcagatggctttgcgcactcactttaatcagtccgaaataggctgcccgagcgtagcggaatttacggtgcagcgtaccgaagctctgttcgaccacatatagtggattaaatttaaaccagtacggcgttgcctcgccttgccgtactatttgtactgtctgcggcttcgtcgccttgtcctgatttaaatttaatccactataacgggtcttcgacaaataccggttgcgtttggtttgcgtttccgtcagcggacggttgcggcaggctttgcgcataatgccgtcctgcaactgatgttcttccagatgttgccggttttccgcactgtcgtagcctttgtcggcatagacggtcgacctttgggcagtccttccaacaaaggcggcaggtgtttgcactcatgggcattggcgggggtaatgtgcagtttctcgatatagccttccgcatcggtacgggtatgttgtttgtaaccgagtttgtagaggccgtttttctttatccaacgggcatcgctgtccttactcggtgtggtttggccgttgatttgtccttcctcatcgacttctatagcctggcgctgtttgctgccgacggtctgaataatggtggcgtcaacgacggcggcggatgctttctctacttttaagcctttttcggtcagttggcggttaatcagttccaacagttcggacagggtgtcgtcttgcgccagccggttgcggtagcggcataaggtgctgtaatcggggatgctcagttcgtcaaaacggcaaaacaggttgaaatcgatgcgggtaatgaggctgtgttcgagttcgggatcggagaggctgtgccattgtccgagcaggacggctttgaacatggacagcaggggataggcgggacggccgcggtggtctctaaggtaacgggttttttgacggttcaggtactgctcgatcggctgccaatcaatcacctggtccaacttcaatagcgggaaacggtcgatgtgtctggcaatcatggcttgggcggtttgctggaagaaggtgctcatggaaaatcccctaaatgtcttggtgggaatttaaggggttttggggaattttgcaaaggtctcagtctatgcccgatatacaattttgatacacaaacttggaaatatcggtatcgtcgccggagcgatagaatgcggacagtttttcattgaattgcggcatctgcatttcggagatttccaagatgccgcagccccccgccatcatcagaccgttggcaaataaggttgccgttcgtttgttgccgtcccaaaaaacctgctgccgcatacaataaagcataaaacggacggctgcctccgtcgtcgaaccgctttgcagtccgatattttgtaacacgcgggccacttcaatttccttcactggattcggggcatgacgggaaccgtccaatagcgttacgccgaccgaaccggtacggaaatcaccgggtgccaaagaatcgtccttggcaacaatgttgttgatttttttaaggagtgaaatatcgaccggttcgccgtttgaaatatgcgaaatcacatattgataggcacgtttcaggttcaagatggtttggatgtcttccagtgacgcggaggctacatttttgccatggataatttgttcggtctgcaacaaggtcgtctgacaattctcaaaacgactgaggttgtgaatttgggcaaccaatactttctttgccaaaaaaatattttctttcaaactcaacttgtatttgtcgggaaacacgataattccttaaataattaaagcagtacgttaaatcatcatcttatcatcactttcggggtttatgttgcgtgcgtccgttttctaatacggtttcccatcccgcgaaacgaggcggaggcctgtgcaaaaaacctgttcacgaaattttccgcattaacgatacgctgaaaatgcgctaaaaatgactgtgtttgaatatcggttgatttcatccgtttgtgtaacctcgcgccggttttgtcatgattttgcattatagtgaattaaatttaaaccagtacagcgttgcctcgccttaccgtactatctgtactgtctgcggcttcgtcgccttgtcctgatttttgttaattcactatatttttgtcatgcggatatttcacgggatgacaaaacgggcgcaaaaaagcccgattggaaaatccgaatcgggcttttttgtgatgttctgttcgatttgcgtactaactgccggccggagcgtccgcgcccggtttggcaggtcggattctcgaatccgacggctatttgagatggcaggcttttgtcggatacaagtatccgacctacggcttgcttttcgtcattcccgcgaaagcgggaatctagaatctcggactttcagataatctttgaatattgctgttgttctaaggtctagattcccgcctgcgcgggaatgacggttcagttgctacggttattgtcaggtttcggttatgttggaatttcgggaaacttatgaattgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcgaattgtcattcccacgcaggtgggaatctagtctgttcggtttcagttatttccgataaattcctgctgctttttatttctagattcccactttcgtgggaatgacgaaaagttgcgggaatgacggttcgggcattccttaaatcacccgtgtatcgctgtaaatcttagagatggcggaatatagcggattaacaaaaaccagtacagcgttgtctcgccttagctcaaagagaacgattctctaaggtgctgaagcaccaagtgaatcggttccgtactatttgtactgtctgcggcttcgtcgccttgtcctgatttttgttaatccactatactataggaacatttagaaaaaatataccaaaaattaaattttatttaaataaagatagcatataacacctttcaatcaatgtgcctcttcccaattctcccctacgccaacctcagccaccagcggtacatccaataatccgccgtccactttcgccataatctgcggcagtttttctttgacaaaatccagttcggtttcaacgacttccagcaccagttcgtcatgcacctgcataatcagtttgctttgtaagagttcgtcccacggggaggcttcgcactctgaaagccagcgggacacgtctatcatggcgcgtttgatgaggtcggaggcggtgccctgcatgggggcgttgatggcagcgcgttcggctccggcgcgggcgttggcgtttttgttgcggatgtcgggcaggtagagccttctgccgaacagggtttcgacgtagccttgggcggcggcttgttctttggtgcgctgcatgtattcggcgacgccggggtagcgggcgaagtagcggtcgataaagtttttggcggaaaggttgtcgatgcccaatgattttgccaaaccgtattgccccataccgtaaattaagccgaagttgatgcttttggcatagcggcgttgctcggacgagacgttttcgggcgcagtgccgaacacttcggcggcggtgcggcggtgtacgtcttcgccgttttggaacgcggcaatcagggttttgtcgccggagaggtgcgccataatgcgcagctcgatttgggaatagtcggcggaaacgatgacgctgccttgcggtgcggtaaaggcgcggcggactttacgcccttcttcggtacggatggggatattttgcaggttggggttgttgctggcgaggcggccggtaatggcgacggcttgggcgtaggtggtatgcacgcggccgtccttgggggaaatcatttcgggtagtttgtcggtgtaggtggatttgagcttcgccaggctgcggttttgcaggatgattttaggcagggggtagtcgggcgcgagctgttcgagcacggcttcgttggtggaaatgccgcctttggcggtttttttcaggcctttggtggggatgcccattttgtcgaacaggatttcttgcagctgtttgggcgaattgaggttgaacggctggcctgcggcggcataggcttcctgttcgagcttcatcagctcggcgccgagttccgcgctttggcgggcgagttcggcgcggtcgatttgcacgccgttgcgttccatttcaaacaatacctgcgcgacgggcagctccattttttcatacatttcaagctgtttttcgtccatttgcgcgcgcaggtgcgcttcgaggcgcagggcgaaatcggcgtcttgggcggcgtattcggtcgcctgcccgatggcgacatcggcaaaaccgatttgcttcgcgcctttgccgcacagcgattcgtaggtaatggtttccaagccgagccagcgttcggacaattcgtccaagccgtgtccgagatggctctcgatgatgtaggaagcgagcatggcgtcgccggcaatgccgttcagggcgatgccgtagttggcgaaaacgtgttggtcgtatttgaggttttgcccgattttttttagggcggggtttcccaaatgcggtttcagacggcctaatacgtcttgtaaatcaagctgttcaggcgcggcggtcaggctgtgtcctacggggatgtaaaccgcttcgcctgcttggaaagcgatgctgatgccgaccagcgaggcgttcatcgcgtctaatgacgtggtttccgtatcgatgccgattgtgtccgcccgcgacagtttgtccaacaaagcggcaaactgcgcttcggtggtaacggcttgataatccagtttttcgggggcggtggctttttcggcttgtttttcaaacggcatttccgcattcaaagccgcctgctcgccgatgctgtcgctgccgaacaaatcatcggtcgagccggtattcatgtttgattccgcttctttcagccaggtgcggaagccccagcgtttgaaatcgacaaccagctgcgcccatttcggcgtagtacggcgcaggctttcgatgccgtctgaaagctcggcgtgcaagtccacatcggttttaatcgtgaccaaatcatacgacagcggcagttggggcagcgcggcttgcaggttttcgcccactttgcccttgatttccgaagcgtgttccatcacaccagccagcgaaccgtaggcttccagccatttcaccgccgttttcgggccgcatttttccacgcccggcacgttgtccaccttgtcgcccatcagcgcgagataatcgcggatttggtcggggcgcacgccgaattttgccttcacgccttcaatgtccagcgtttcgctgctcatcgtgttcaccagcgtaacgcgctcatccaccaactgcgccatgtccttatcgccggtcgaaacaatgactcgcaaaccatgttccgccccctgtttcgccagcgtgccgatcacatcgtccgcctccacctgcccaatcaccaataccggccagcctgtcaggcgcactaaatccggcagtgcttccgcctgcgggcgcaaatcgtcgggcatcggcgggcgcgtcgccttgtattcttcaaacatttgatggcggaaatttttgcctttcgcatcaaaaaccaccgcgcaataatcgtgcggatattccgaccgcaaacggcgcaacatattcaatacaccatacagcgcacccgtcggcgcgccgtcgggggcggtcaggttttgccccatcgcgtgatacgcacggtagaggtaggacgatccgtcaacgaggaggagtgtaggtctgttggacataaaaaacccgcttaaaaccgataagggacagaaaaaaatagggaaggacgatgccggcttaaaacccgcccccggacaaccccggattataacggaaaaggcaaatgccgtctgaaacccttgttcagacggcatttttggcggattaggcgttcagcagcccttcatccagcgtcagctcttcatttttgttcaccgccactttgcgcgccaacacgttttgcgcgatttgctgcgcttcggcgagcgagtgcatttgataagtgccgcattggtattcgttcaactcggggattttgctttggtctttgacattcaaaacatcctgcatcgaagccagccacgcatcggcgacctgctgttcggaaggcgtgccgataagactcatataaaaaccggtgcggcagcccatcggggaaatgtcgatgatttccacgccgttgccgttcaagtggtcgcgcataaaacctgcgaacaaatgctccagcgtgtgtatgccttttccaggcaggatttctttgttgggaacgcaaaagcgcaggtcaaacacggtaatggtgtcgcctttgggcgtagtcatggttttcgccacgcgtacggcgggggcatgcatacgggtgtgatcgactttgaaactgtctagtaggggcatttgggtatccttttgtgagggttatgtagattttcgggataggattttgtccagcaattcatcatccaagacgcggttttcgactttcacccattcgccgcctgcttcagggaagccgttgcggcaatatcctgcctgttcgacaaaatcatagacggcatgaatgtagtcgttgatacacaatgcggctatggtgcaggcatcatcccataaaatcaagacatgattggggatatgtttgtcggatacatcttcgacattatagatgtgcaaggcatctaaaatcccgtcttgcgaagcggcatagaagtagcctgtgtcgccgtcgtcttcaaagacgacaccataagggatatgtttggaaaatgattctaaaactttaggcgtgccgacagtaaagtctttgatttcagaagtcagatatagcggtaattgtgccattgggtaacgctctctttagtgaattttatattaattttgatattccatagttcactaaaaatccaccaaccactagccataaataagttagtattcctaaaacaaacggttttaatcctgcctttttgattgcgcttgcttgcgtcgttaagccaagcgcagccattgatgaaattaataagaaagaatcgatttcaacgaataatttcacgagttcttttggtaataaatcaaaagaattaaaaatggcaacaccaataaaaagtacagcaaaccaaggaattgtaattttgtgtgatgtattttctgatactccattactacgtgttaataaccaagaaagcattaataaaaagggggcgagcatcatcactcggatcattttggaaatgacggcagtattcgccacgataggatcaatattttccccaatcgcatacacttgagccacttcgtgtacactagaaccaacataaataccgaattgatgggcgttaattaaatgttgtgaccacgtgtagaacaaggggtaagtaaaaatagcaagcgtcccgaaaatgaccactacggcaatcgccactgaaactttatgggattctgctttagtaacaggctctgccgccatcactgctgccgcaccgcaaatgctgcaacctgccccagtgagataaaccaattgtttatccatttttagataacgaatgcctaaaagtgcggtaaaaaagaaggttgaaattagcatgattgcatcagtgacaaccgcatttaatcctacatcggcaatatcgccaaaagtgaggcgaaaaccatacaacacaatgccagtgcgaagaagcgcgcctttggcaaacaaaacgcctttttccacttgtgtcgaaaattgcggataaatggtattgccgattgccattcccagcaagatagcaataattaaagcactgatatgataatgatgggaaaaatcagtgtttcctaaatagttagcaagtatagcgataatcgcgataaatatcagtccgaaataaaagggacgtgtgttcattttttctttccgtgataacacccaaatcacaattccgcaatttccaccgcttcgcccgaagccgcgctcagggcttcgtttaaaacgtcataaaaatcgcgtccgtcgcgcgttgccagccatttgccgttttgctcggcgaaatggtagccgccgctttttgcggcaatccacaattcctgattgggcgtgtggcggttgacgatgatttgggcgccgtctccggcttcgatggtcaggacgtttccggcaaaccggcagtcgaaatcccagccgttttcgtcgatttggtcttcgatgtgttcaaataatgcttcgctcgcgcggataaactcgctttcggtcatcatagctttttgcgtgttttttgtttaagatgccgaatcttgccacattcgcgcttatgaaggaagtttaccgatgaaatacggcgtattttttgcggcggcaaccgccctcctgctctcggcctgcggttacaaaggcgacctctacctgcccaaagaaggcgacaaggcgcgtttcggcgtaatccaaaccggtttgcaacttcaaagcaaaccgcaatccgctccacaaacccaaaaatgaaaacgaaaacatgaccctattttgcgaacaagtcccctacccccgccttgctgaagcattcggcacaccgctttatgtgtacagccaatccgcgctgaccgaagcatttgaacactaccaaaccgcgtttgccgctttgaacccgctcgtctgttacgccgtcaaggcaaacggcaatctgagcattatcaaacacttcgcctcgctgggcagcggttttgacattgtgtccggcggcgaattggcacgcgttttggcggcaggcggcgacgcggcaaaaaccatattttcaggcgtaggcaaaagcgaggcggaaatcgagttcgcgctgaatgcaggcgtgaaatgcttcaatatggaaagcatccccgaaatcgaccgtattcagaaagttgccgcacgtttgggtaaaaccgcgcccgtctccctgcgcatcaaccccgatgtcgatgcaaaaacccatccctacatctccacaggtctgaaagccaacaaattcggcatcgcctacgccgacgcgctcgaagcctaccactatgccgcacaacagcccaatttgaaaatcatcggcatcgactgccacatcggttcgcaactgaccgacttaagcccgctggtcgaagcctgcgagcgcattttgattttggttgacgcgcttgccgccgaaggcattgttttggaacatttagacttaggcggcggcgtcggcattgtttaccaagacgaaaatgtgcctgatttgggcgcgtatgcccaagccgttcaaaaactgatcggcacacgccgtctgaaactcattcttgagcccggccgcagcctggtcggcaacgcaggttcgctgctgacacgcgtcgagtttgtcaaatacggcgaagagaaaaactttgtgatggtcgatgcggcgatgaacgatttgatgcgcccggcgctttatgatgcctatcatcacatcgaggcggtcgaaaccaaagacatcgcgacgctgaccgccaacatcgtcggtccgatttgcgaaaccggcgacttcctcggcaaagaccgcaccatcgcctgcgaagaaggggatttgctgcttatccgcagcgcgggcgcatacggggccagtatggcgagcaattacaacgcgcgcaaccgtgcggcagaggtgttggtggacggcaacgaataccgactcatccgccggcgcgaaaccttggaacagcaaatggcaaacgaactcgcctgcctgcaagccgaacatcaaaatgccgtctgaagcggttcagacggcatttttaacgctctaaaggcttactcgttcggcagccttaacagggaaagcagcagccctccccagattatcacgattgagacaatcatcatcacaatggcggaagtactcatttttcttctccttgttcatgttcgtgttcgtctttgacgttgaaatcctgaccgtgtttccaaggcagcaacgacagcagcagcccgaacacgaccaacgccgccgacatcccccagccgaaaatactgaggaaaccatccggataaccttcgtaatttttctccatcaggccgctggtatctttaaacagcatatagccgagcatcacgacggtaaccacgacgcagaccgtccacaagccgccgatgcggatggaggacaaagcgttcaggtgcttgcgtaattccggcagcctgccgctgatgatgatggcggcaacataaacaaagccggcggcaacaatgccgtaggtgttgacgaatttgtccatcacgtccaaaaccggcagccccgtcgccgtaccgaacagcagcgtggaaacaatgcccatcggaatgcagaccagcagcgtggcgttgacgcgcccgatgttcagcttgtcctgaatcgccgccacaatcacttcaaggatggaaatcatcgacgtaacgccggcgaacaccagcgaaccgaaaaacaatatgccgatcagccagcccatcggtgcctggttgataatggtcggaaaggcgataaacgccaaaccgatgccgcctgaggcaacctcgttgaccgccttaccgcccgcntgcgccataaagcccaatgcggcaaacacgccgatgcccgcgagcagttcaaagctgctgttggcaaaaccgaccaccagccccgttccgcccaagtcggtttttttcttcaaataagaagaataggtaaccataatgccgaagcagatggaaagcgaaaagaaaatctgcccgtatgccgccacccagaccttggaatcggcgagtttcgaccagtcgggcgtaaacaatgcgtccaagccctttgccgcacccggcagggttagtgaaatgccgaccataatcaaaaacatcaccaaaagcagcggcataaagaacgacgaggcgcgcgccacgcccttttgcacgcccaacgccataatggcggcggtaaaaacccacacgcccgccaaaggaccggcgactttgccgacaaaatccaaacccaaggcttccgggcccgccatttgcaggaagtccttaaagaaaaaaccctgcggatccgcaccccaggcggcgttgaccgaataataggtatagcttgccgcccaaccgataattaccgcgtaatagatgcagatgacgatattggtcatcacgttccaccagccgaccggctcaaaccatcgtccgaggcggcggaaagccaagggcgcagaaccacggtaacggtggccgatggcataatcgagcagcagcagcgggatgcccgccgtcagaagcgcgaccagatagggcaggatgaacgcgccgccgccgttttcaaaagcaatataggggaaacgccaaatattgcccaagccgacggcggacccgatggcggcaatcataaacgcgcggcgcgtgccgaatgtggcgcgttctttcgtcttggaatcagacacgttgatacctcttgaattatttattaaaaacaagccattataggcgaaatatatagaaatagcgtctgacagggataatgtcttctgaaaaaacaaaccggcttgtggccgattgtttacaatctatgtgcttatcgtaaaaaaatttaacgctgatggcaagcggtgaaggcttgaaaacgaaaaattttaggggctgtactagattagccctaaatcccacaccaatcccgcaggattttaagctgttgagacggtgtgccgaagttaaatcgaaattcgcattctttcaagaacagcgggaaagatttacgatcgattccattgtattttcgcaagacacgttttgcctgattccaaaaattctcaatgccgttaatgtggttctgacggtctgcaaatccttggaawggktgatgcggtataaatgaaaccgctcactccaacttgtcgcarctgctcagactatcggtataaacaatactgtccggcatgattttcttcttgatgacagggagtaacgtttcagacttggcattatccaccacaacggtatagacccgtccgttgcgtttcagaatgccgaagacaacactt

SEQ ID NO: 37791 - DNA, 52253 bp, Neisseria meningitidis
tgctgcacaactgggcgtaaacgaagccgacgtgaaaaacgaatcttccttccaagacgacttgggcgcggattctttggacaccgtggagctggttatggctttggaagaagcattcggctgcgaaatccccgacgaagatgccgaaaaaatcaccaccgtccaactggctatcgactacatcaatgcccacaacggctaaccggtcgtcgcccgacacaacagcctctgctgcaccgcgcaatagaggcttttcccttatatggcaaactgtttgaacccctgccgcaaattacagacggcatctgcacgacagccgcatatgcccccattccgacaaccaacagcgaggttatcatgagtcagagaagagtagtcattacaggcttaggtcaggtttcccctgtcggcaacactgtcgcagaggcttgggacaccctgctcaccggcaaaagcggcatcggcgcgattacccgctttgacacatccgacatcaacagccgtgtcgccggcgaggtgcgcggtttcgacatcggacaatacatcagcgcgaaagaagcgcgccggatggacgtattcatccactacggcattgccgccgcattgcaggcaatcgccgattcgggtttggacgatgtggaaaacctcgacaaagaccgcatcggcgtgaacatcggttccggcatcggcggactgcccggcatcgaggtcaccggcaaagccgtaatcgaaggcggcgcgcgcaaaatcaaccctttctttatccccggttctctgattaatctgatttccggacacgttaccatcctcaaaggctaccgcggcccgagctacgggatggtttccgcctgcaccaccggcgcgcacgccatcggcgattccctccgtatgattaaatacggcgacgcggacataatggttgccggcggcgcggaaggcgcaatcagcactttgggcgtgggcggttttgccgcgatgaaagccctctccacccgcaacgacgaccccgccaccgcttcccgtccgtgggacaaaggccgcgacggcttcgttatcggcgaaggcgcgggcatattggtgttggaagaattggaacacgccaaaaaacgcggcgcgaaaatctacgccgaaatcgtcggcttcggcatgagttccgatgcttaccatatcaccgcgccgaacgaagaaggccccgcccttgccgttacccgcgcgctgaaagatgccggcatcaatcccgaagacgtggattacgtcaacgcgcacggcacgtccacccccttgggcgatgccaacgaaaccaaagccctcaaacgcgcgttcggcgaacacgcctacaaaaccgtcgtcagctcgaccaaatccatgaccggccacctgctcggcgcggcgggcggcgtggaggccgtgtacagcattttggcgatacacgacggcaaaatcccgccgaccatcaacatttttgaacaagacgttgaagccggctgcgatttggactactgcgccaacgaagcgcgcgacgcggaaatcgacgttgccatttccaactccttcggcttcggcggcaccaacggcacgctggtcttcaaacgcttcaaaggctgattccgcaaagccgccgccgacatcgaaatgccgtctgaaaccgtttcagacggcatttttatagtgattaacaaaaatcaggacaaggcggcgagccgcagacagtacaaatagtacggaaccgattcacttggtgcttcagcaccttagagaatcgttctctttgagctaaggcggggcaacgccgtaccggtttttgttaatccactataatacgcaggcaaacccaagccttgctgggttacaggatgaaaccctgccgtagcagaccgcatttccaatccatattcaaggtgtccgccttatgaaaatcgtttttatcacaacagtcgcatccagcatttacggtttccgcgcccccgtcattaaaaaattaatcggcaaaaaccatcaggtgtatgcctttgtatcggagttttccgacaatgaattggatattatcagggaaatgggggttacacccgttacctaccgttcaaaccgcagcgggctgaacccgttttcggatataaaatccaccttcctcatctttaaagaactcaaaaaaatatcgccggatttggttttcccttatttcgcaaaacccgtgattttcggcacttttgccgcaaaactggcaggcgtgcccagaatcgtcgggatgctggaaggtttgggattcgcatttaccccgcagccggaaggcataccgttaaaaacaaaaatcataaaggggattttgattgccttataccgcattgccctgccgatgttggaaagcctgattgtattaaaccccgacgacaaagacgaactgacggacaaatacggcatcaaaataaaaaacatccatattttgggcggaatcggtctggatttgcggcaatatccttattccgaggcggatattcccgatgaaaaagaacccgtaaaattcctctttatcggcagatttctgaaagaaaaggggattgatgattttattcgggcggcggaacaggttaaggacaaataccccgatacggtttttaccgctttgggcgcaatcgacaaatcacgcgggggggggggcgatttggaacggcttgccgcccgcgatattatccgtttccccggttttgtgaacaatgtttccgaagtgataaaagaacatcatatattcgtattgccgtcttattatagggaaggcgttccccgaagcactcaggaggcaatggccgtcggcagggcagtgattacgacggatgtccccggatgcagggaaacggtcgccgacaaggtcaacggcttcctgatcgagccttggaatccccgcatcttggccgaaaaaatgatttattttatcgaaaacagggaagccgtccgcctgatggggaatgcaagttatgcgattgccaaagataaattcgatgccgaaaaagtcgatttgaaattgctcgatattttgaaggcgtaaacaaggctgcccgcttttgagtttcggtcatttctgataaacccccgtcattcccgccacacccccgtcattccctcgaaagcgggaattcaggttcgtttagtttcggtcatttccgataaattcttgcaactttgcgtttctagattcccactttcgtgggaatgacggcggagggttgctgttttcctgacaaattcccgccatctaaaatctcgttatccatacaagaaccgaaaatcttgccattctcacaaaaacagaaattcaaaaacagaaatcccaaaccctcgtcattcccgcgaaagcgggaatccaggttcgttgagtttcggtcatttccgataaattcttgcaactttgcgtttctagattcccactttcgtgggaatgacggtaaagattgagacctttgcaataacataggttactaaaattttatgctcaatctcattttcaaaatgcaaaacttttctgatttctcctactttttgctcaatattaggaaggttttaggcaattgaaaattttttggcgcatttttatgcgtcaaatttcgttaacagattatttttgcaaaggtctcagattgctgttttcccgacaaattcccgccatctaaaatctcgttatccatacaagaaccgaaaatcttgccattctcacaaaaacagaaattcaaaaacagaaatcccaaaccctcgtcattcccgccaaacccccgtcattcccgcgaaagcgggaatccaggttcgttgagtttcggtcatttccgataaactcttgcagctttgcgtttctagattccctctttcgcgggaatgacgggatgcaggtttccgcgcggacggattcggcattcccgctttcgcagaaatgccggcttttggtttgttgtctttataagattattcggcaattattctgcggttttgcgtttgtgtgctgccggaatctcaaaggattctctgtatttggcaatggtgcggcgagaaacctccatgccgcggaaagccagcaggttggcgagcgcctcgtcagaatacggcgtgggcgtggacgaggcaaaaccggcggcgggaaagggattgagcgaagcaatgaggtcgagtgcggcttcgagtgtgccgctgtcggtttggggcaggtgtttttttattcgtgcgagggtttggctgcggttgccgtcaatgctgtcgagggcgtttcggacgatatgcagggcggcgggtttggcagcacattcgcccaatctttctatctgcagtatcagcgattcgttcaaatcggcggcggccacgcctgccgggtcgaattttttcaatgcggtcagcgcgtgttgcagcattgcttcatccaacatccactctaagggcgtatggtcgaggatgtcttcgatgctgtcggtcagataaccctgctcgtcaaggaaatcgataaggatgtggacacaggcggcttcttggtcggaaagcgggtgttcgcatacttgcgcgtgcaggtattgcttgaaatcctgctcgccggcgatgttggacagcatatcttcgccttcgtctccgccgatttgacgggcaggcgcagtgtaatggctgaactcggcatcggaaaattcatccgtgtctttgcgttcgagcagggggttgtccgacagccagttttcgacctcgcgttcaagttcgatacccgacatctgcaatacgcgcaaagattgttgcagccgctggttgagctgctgggtctgtttgagctttattccgagtaaggtcatgataatgtggggaaaattgttattttcagcctgtcggcgcaaaaaatgccgcaaagcgtcattgcattataaatggttttaatgagcgggttcggattccgttcgataacaaaaaacaaacgaaaatcaagaaccgattgcttataataatattaaatcgatttcatagttttaatagcgaaaatcttggcgtatagtcgcatccatagtttttacaaaagggaaataaaatgtcgattcaagaaatttattgcaatcaagaaaccggttacgaatacgctttccgccaaatcgtactgtaagccgtttacccccatttgaccaacctgagaaaaggaacaagagcgatgactacctccaaatgccctgtaacccatctgaccatgaacaacggcgcgcctgttgccgacaatcaaaacagcctgaccgccggtcctcgcggccctctgctggcgcaggatttgtggctgaatgaaaaactcgccgacttcgtgcgcgaagtcatccccgaacgccgtatgcacgccaaaggttcgggcgcgttcggtacgtttaccgtaacgcacgacatcaccaaatacacccgcgccaaaatcttcagcgaagtcggcaaaaaaaccgagatgttcgcccgtttcaccaccgtggcaggcgaacgcggcgcagccgatgcagaacgcgacatccgcggttttgccttgaaattttataccgaagaaggcaactgggatgtggtcggcaacaacacgcccgtgttcttcctgcgcgacccgcgtaagttccccgacctgaacaaagccgtcaaacgcgacccgcgcaccaatatgcgctctgccacaaacaactgggacttctggacgctgctgcccgaagcactgcaccaagttaccatcgtgatgagcgaccgcggcatccccgccggctaccgccatatgcacggcttcggttcgcatacctacagcttctggaacgaagcaggcgagcgtttttgggtgaaattccatttccgcacccaacaaggcattaaaaacctgaccaacgaagaagccgccaaaatcatcgccgacgaccgcgaaagccatcagcgcgacttatacgaagccatcgaacgcggcgagtttccgaaatggacgatgtacatccaagtcatgcctgaagcagacgcggaaaaagtaccttatcatccgtttgacttgaccaaagtttggccgaaaaaagactatccgctgattgaagtgggcgaattcgagttgaaccgcaatcccgaaaacttcttcgccgatgtggaacaatccgccttcgcaccgagcaacctcgttcccggtgtcggcgccagcccagataaaatgctgcaagcgcgtttgttcaattacgccgacgcacaacgctaccgtttgggcgtaaacttccgccaaattcccgtcaatcgtccgcgttgccctgttcacagcaaccagcgcgacgggcaaggccgcgccgacggcaactacggcagcctgccgcactacgaacccaacagcttcggccaatggcagcaacaacccgacttcgccgaaccgcctttgaaaatcaacggcgacgcggcacactgggactaccgccaagacgatgacgactatttcagccaaccgcgcgccctgttcaacctgatgaacgacgcgcagaaacaggcattgttcggcaacaccgccgccgcaatgggcgacgcgcccgacttcatcaaataccgccatatccgcaactgctaccgttgcgacccggcatacggcgaaggcgtggccaaagcccttggactgactgtcgaagatgcccaagccgcccgcgcgaccgatcccgcactgggtcaggctggtttgctgtaagggggcattatgtggatggaaattgaagaaatcctgtcccgcgccgtccgctatcggaaataaccgggcataaaaatgccgtctgaaacattgtccgaccgtttcagacggcattcccccatcccgccccgccgtttcagcgggcgttttttattaaacgcaaaatatcccgtcattcccacgaaagtgggaatcaaggactcggggttggagaaaccgttttatccgataagtttccgcaccgacaactctggattcccgcctgcgcgggaatgacgggatttctgtttttgattttttgtttttgcgggaatgacgggatgcgggttttcgtgcggcatttttgcatttttttgcttttgctataatccgccctttttgaggacgggtgcggtatgggtttttatgctttgctcttgattgctctggggatgtcgatggatgcgtttgccgtcgcattggcaaagggtgcggcggtcagaatgcctccgcgcaaaattgcggcaacggctttggtgttcggcacggttgaagcgctcacgccgctggcaggctgggtaggcggtttttatgccaagccgtttatcagcgaatgggaccattgggtggctttcgtcctgctgggcgggctgggtctgaaaatgatgcgcgaagggctgtccggcgaggcggaagatgtgcgcgaaagcaaacgggaaagcctatggatgacggttttgactgcttttggaaccagtattgattccatgatagtcggggtgggcttggcgtttatggaggtaaacatcgcctttgccgccgcaatcatcggtatggcgacgacggtgatggtggcggtcgggctgacggcgggaagggctttgggcgtattgttcggcaggtgtgcggaatttgccggaggtttggtgttgattgccatcggcacatggacgctcttgtcgcatttgggtttgattcaatgatgtcggaaaatatagtggattaacaaaaaccagtacgtcgttgcctcgccttggctcaaagagaacgattctctaaggtgctgaagcaccaagtgaatcggttccgtactatttgtactgtctgcggcttcgtcgccttgtcctgatttttgttaatccactataaaatgccgtctgaagcgttgtttgaccgtttcagacggcatttttatcaaattcaaaaatattccgtcattcccgcgaaagcgggaatctagaacgtaaaatctaaagaaaccgttttatccgataagtttccgcaccgacagacctggattcccgcctgcgcgggaatgatgggatttctgtttttgatttttttgtttttggggaatgacgggatttgagattgcgggcatttatcgggtaaaacggaaattaaacgttgcgaaaatttatccggaatcacagcaacttttccgcgtcattcccacgaaagtgggaatctagaacgtaaaatctaaagaaaccgtttttcccgataagtttctgcaccgaccggtctggattcccgcctgcgcgggaatgacggtgcggatgtttttctatcgaatccgccatattttttacttcaaccctgccgtcagaccgcgttgtcgaaaccgctgtggcgcaagagtgcgtctatgctcggttcgcggccgcggaaggctttgaaggattctgccgcgctgcgcgatccgccgacggcgaggatttcctgccaaaagcgtttgcctgtggcggcgacatcgtcgctttcttcaaaggcggcgtatgcgtccgcgctcaatacttccgcccacgcgtagctgtaatagcctgcggaatagccgcctgcgaagatgtggccgaagctcaaggcgaagcggttgtattcgggcggctggatgacggcgacttttttgcgcacgctgtctaaaacctgttgccagtttttcagacggccttcgtcgtcttcgctgtaaatcatcatatcaaagagggcgaactccatttgccggacgaggaacatgccgcgttggaagtttttggcggcgagcattttgtcgaagagttctttcggcaggggaacgccggtttcttcgtgggctgacatttgtgccaagacattgtattcccaaacgaaattttccataaactggctgggcagttcgaccgcgtcccattctacgccgttgatgccggatacgcccagttcgtccacttgggtaagcaggtggtgcagcccgtgtccggtttcgtggaagaggatgaggatttcgtcgtggctcaggcgggcttccctgccgccgacgggtggggcgaagttgcagacgaggtaggcggtgggcagttgcagcgtgccgtctgaaaaacggcggcggcctttgtagtcgttcatccacgcgccgccgcgtttgccttcgcgtgcgtacaaatccatataaacgccgcctatggtttcgccgttttgttgcaattcaaaatagcgcacgtctttgtgccagacggggacggttttttcggtaaatccgatgccgtagagttttttgatttgggcgaacagtccgtttaatactttgccgacggggaagtattttttgacttcggtttcgctgaacgcgtatttggcttcgcgcagtttttcgctggcgtagcccaagtcccacggttgcaaatcggcgaggttcaggctttcgcgggcgaaggctttgacttcggcgaggtctttttcggcgtagggtttggcgcggcgggcgaggtcgtgcaggaagtttaaaacttgttcgggcgtgtccgccattttggttgccagcgacaattcggcgtagtttttgaagccgagcagtttggcggtttgcagggcgtttgcgagcgtgcggtcgatgttggcggtgttgtcgaatttgccgtcgtctgaaagttcgctggcgcgggtaacgtaggcgcggtagatttgttcgcgcagttcgcggttgtcggcgtattggatgacggcgaggtagtgtggaatctgcaagccgattttgtagcctgttttgctttcgctttgcgcggcggcggcaaacatggcgagcgcgtcttcgggaatgccggcaagcggtgcggcatcgtcaaagtaaatgccgaacgcgtcggtcgcgtctaggacgttttgggagaatttggcggaaagttgcgcgccttcggtttgcagttttgccagttctgcctgctgttcgggcggcagttccgcgccgctgaggacgaaatcgcgcagatcgtggttgagtttggttttttgtgcgggggagagggtgtcgaattcgggggaatttttgatggttttgaagcggttgtacagctcgatgtcttgtccgatttcggtgaagaagacggtgatttcgggcatcagttcgttatagacggcgcgcagttcgggcgtgtcggcgacggagttgaggtgcgacaccacgccccaaatcctgccgacgcgttcggtgatgccggtcaggggttcgacagtgtttgcccagccggtgtgcgtttgggctttgatggcggcgatttgttcgcgcgcttcggcgatggcggtttgcagggcgggtttgatgtcttcggttttgatttgatcaaaacggggttcttcgcccaaatggagcagtgcgttgtcagtcataagatgggtttcctttgcgtgttgtgtttcagacagcatatcggcaatatgccgtctgaagccggaaatggggtcggtcggggaaagttaaagtgtttcggagccggcggggtgatttaacaggcggtattgtacgcgcaaaaattcgtccataaccgcctgttggatttccagccgctttgaaacgggggaagcgaagcggacgatgatgcggtatgccttgtcatcgtacggcacgcgggtaacgcgcggtctggcggcgggcgtgataaacagtttttccgcctgcacgttttccaaatsccgttggatggcggggatgtagggcgcgcacaagggctcgagtacggctttcagacggcatacggcttcatccgaatccaaatggatgggaacggggatttcgaccgtatggatgacatagtcgcccaaaatattgtcgcggcgcacggggtggctcaacaacaggctgttggggaaagaaacggtggttcccgcaagctgtccgaccaaggggttcggaccgacctgcatcatcagcgtgttcaacaggttgatgtcgaccacgcgcccgcgcaggccgttgatttcgatatagtcgccgaccgagtattgctgggtggcagaccttaaaatactgcccgacagacacataatcagttccttcgtcgccacgacgaccgccgccgccaccgcaaacatcgacaaagccagcgtttggatttgcgccgaccagataaatgccagcgaaaacagcaccaaaagcagcgttatattgcggctggcaaccaaaaaccgccgcttgctttcgatgccgaaatccggatgccgtttgaagtggatattcaacagaagggcgcgcgccagcagcaaagccgcaaccgccgccacggattcgaccgcctccgcacgtatcgggacggcaccgagccaagtgtccaacatattccatatttccatttccgcgcccctgtccgaaaagtatagggtgtagattttagtggcaaaaaaacgcttttgccactttacgggacaatccccgacctgatgccggaggcaaacgtaccgtttcatcttttcccggcggcacactgatgcggataacgctgaattaggcggcaaaatcggctataatacacaattatatatgtcgtcccgcccgctttttctacaaggtgcggacttgttttggcggcatcgcaaaatcttttcaaaatccggcaaaaaatatgactgaacaaaaacacgaagaatacggcgccgacagcattcaggtgctcgaaggcttggaagcggtacgcaaacgccccggcatgtacatcggcgacacgcaggacggcagcggtctgcaccacatggtgttcgaagtattggacaacgccattgacgaagcactcgccggacattgcgacaaaatcacggtaacgatacacgccgaccattccgtcagcgtcgccgacaacgggcgcggtatgcccaccggcatccacccgaaagaaggacgctccgccgccgaagtcatcatgaccgtattgcacgcgggcggtaaattcgacaacaacagctacaaaatctccggcggcctgcacggcgtgggcgtgtccgtcgtcaacgcgctgtccgactgggtaacgctgaccatctaccgcgacggcaaagaacacttcgtccgcttcgtgcgcggcgaaaccgaagagccgctgaaaattgtcggcgattccgataaaaaaggcacgaccgtgcgcttcctcgccagtacggaaaccttcggcaacgtcgaatacagcttcgacatccttgccaaacgcatccgcgaactttccttcctgaacaacggcgtggacatcgaattgaccgacgagcgcgacggcaaacacgaaagcttcgccctttccggcggcgtggcgggtttcgtgcaatacatgaaccgcaaaaaaacgccgttgcacgaaaaaatcttctacgcgttcggcgaaaaagacggcatgagcgtcgaatgcgcgatgcaatggaatgacagctatcaagaaagcgtgcagtgtttcaccaacaacatcccgcaacgtgatggcggtactcacctgaccgcactgcgccaagtgatgacccgcaccatcaacaactatatcgaagccaacgaagtcgccaaaaaagccaaagtggaaaccgcaggcgacgatatgcgcgagggtttgacctgcgtgttgtccgtcaaactgcccgaccccaaattctcgtcccaaaccaaagacaaactggtttccggcgaaatcggccccgttgtcaacgaagtcatcagccaagccctgaccgacttcctcgaagaaaatccgaacgaagccaaaatcatcaccggcaaaatcgtcgatgccgcccgcgcgcgcgaagccgcccgcaaagcacgcgaaatcacccgccgcaaaggcgtgatggacggcttgggactgcccggcaaactcgccgactgccaagaaaaagaccctgccctgtccgaactctacctcgtcgagggcgactccgcaggcggttccgccatgcaaggccgcgaccgcaaattccaagcgattttgccgctcaaaggtaaaattttgaacgtcgaaaaagcacgttttgaaaaaatgctggccagccaagaagtcgccacgctgattaccgctttgggcgcgggcatcggcaaagaagaattcaatgccgaaaaactgcgttaccaccgcatcatcatcatgaccgatgccgacgtggacggcgcgcacatccgcaccctgctcctgaccttcttctaccgccaaatgcccgagctggtcgagcgcggctacatctatatcgcccagccgcctttgtataaagcgaaatacggcaaacaggaacgttacctcaaggacgagttggaaaaagaccaatggctgctcggtcttgccttggaaaaagccaaaatcatttcagacggccgcaccatcgaaggcgcagaacttgccgacaccgccaaacaattcctgttggcaaaaaccgtcatcgaacaggaaagccgcttcgtagacgaactcgtcctgcgcgccatgctacacgcgtcgcccattgatttgacgtcgtctgaaaacgccgataaagccgttgccgaactttccggtctgcttgacgaaaaagaagtcgccctcgaacgcatcgaaggtcatgaaggacaccggttcatcaaaatcacgcgcaagctgcacggcaacgtcatggtcagctacatcgaacccaagttcctcaacagcaaagcctaccaaaccctcacccaaaccgccgccgcgctcaaaggcatggtcggcgagggtgccaagctttacaaaggcgaaaacgggtacgacgcggacagctttgaaaccgctttggacatcttgatgagcgttgcccaaaaaggtatgtccatccaacgatacaaaggcttgggcgagatgaaccccgagcagctgtgggaaaccacgatggatcccgccgtgcgccgcctgttgaaagtgcgcatcgaagatgccattgccgccgacgaagtgttcgttacgctgatgggcgacgaggtcgagccgcgccgtgcctttatcgaaaacaacgcgctgattgcccaaaatatcgacgcataagtgccgttttaaaaaaggagacgggcatcgtgccgcgtctcctttttggttggtcaaacggaacctgtgccgtctgaaaaaccgtcggagcaaaatatgatcagcattttcgatattttcaaaatcggtatcgggccttccagttcgcatacggtcggcccgatgaaggcagccgccgcctttgcggcaggtttggatgcacaggctgttcgcatcgtcatcgacatttacggctcgctcgcactgaccggatacggacacggtacatttgacgcgctgatgctcggtttggaaggcagcctgccgcacgacatcccgcttgccggcattcccgaacgcctcgaacgcatccgcacgcagcacatcctccggctcaacgggcaagaaatccgcttcatccccgaccgcgacctgaacatactcggcaatcaagtgctgcccaaacaccccaacagcctgcgttttaccgcctatgcttcagacggcacggtattgaatgaacaggtttattattcggtcggcggcggctttgtcgttaccgaagaagattttgaccggcaggcggaaacggaaaaagccgttccctatccctataccagttgcgccgaactgcttgcccgatgccgtctgaaccggctcgacatctccgaagtcgtgttggcaaacgaagccgcgcttgccggatgcggcgaagccgaaatccgccgccgcgccgctgccgttgccgaggttatggaaggctgcatcaaacgcggcttgggtgcggacggcgaactgcccagcggattgaacgtccgccgccgcgccccgcagcttgccgccaagctcaaagtcctgcgcgaaaccgaaatcgtcaacacccagctctggccgatggtgtacgccatggcggtcaacgaagaaaacgccgccggcggacgcgtcgttaccgcaccgaccaacggcgcggcaggcatcattcccgccgtattgcactatttccgcaagttcaatccgcacgccacacaggaacgcgtcgaaaacttcctgctcaccgcaggcgcaatcggcatcctctacaagaccaacgcctccatttccggtgcggatgtcggctgtcagggcgaagtcggcgtagcgtgttcgatggcggcgggcgcatacgccgaagtcatcggcggcacgcccaaacaagtggaaaacgccgccgaaatggcgatggaacaccatttggggctgacttgcgaccccgtcggcggactggtgcaaatcccctgcatcgagcgcaacggcatcgccgccgaaaaagccctcaaactcggcacgctcgcgcttttggaagacggcacggacaaaaaagtctcgctcgacgaagtcatccgaaccatgctgcaaaccggccgggatatgaaggcgacctacaaagaaacctcgcttgccggactcgccgccacgctccggaaaaaagccgtccccgtatccgtgcgcgtggtcgagtgctgaggatggacagaaacgaaaatgccgtctgaaaacagttttttagacggcatttcatttatttcttgcggctttaccgtttcagtgccagcgtcaacacgcccgccgtaaccagccccaagcctatccattcctgcgtgttcgggcgttcgtctaagaaaaccaccgccatcaggaatgcaaaccggcgttgtttgcagcatccggcaagaatttttatagtggattaacaaaaatcaggacaaggcgacgaagccgcagacagtacaaatagtacggaaccgattcacttggtgcttcagcaccttagagaatcgttctctttgagctaaggcgaggcaacgctgtactggtttttgttaatccactataaaaggtcttttctaaaatatgcagaaattcgaatatcgaatttgccttatgattacggttttctgtcttatctgccttaaaacgccggtattccgtttgaaccaaattatatttgccgaaacgctcaaaaatctcccttacctgcccgacagacatcaagccttcgttgttgtagctgagaaaatatattgaaagtccgcatccctaatcaaagcctcaaataccggaatcacatgcgattttgagcaagtccgcgctaaaacacatcgtacagcgcaaaaccggatgggaatggcaaaatccggaaacaaacatttttcaaagcatacaaacaaaaaaataccaaccggaggttggtattccttaacttttggcgcggcggacggggctcgaacccgcgacccccggcgtgacaggccggtactctaaccaactgagctaccaccgcgcatccattgtttgcaacaatgaaagaaaacttggtgggtgatgacggagtcgaaccgccgacattctgcttgtaaggcagacgctctaccaactgagctaatcacccgtgtataaaaaataccgacagagtcagtattttgaaacttggcgcggcggacggggctcgaacccgcgacccccggcgtgacaggccggtactctaaccaactgagctaccaccgcgcatccattgtttgcaacaatgaaagaaaacttggtgggtgatgacggagtcgaaccgccgacattctgcttgtaaggcagacactctaccaactgagctaatcacccttgcgatttgcgaaagcgttattaaaccaaataaccggaaatggcgcaagccttatttcggcatttcatttatattccctgcaaactccagttttcaaaagagataatttcttcttttttgcctgcgaccaccaacacgtcaccgccttccaatgtaaacgaggcatccgggttttcaatccggccggtgcggcggcggacgaacaagagtttgatgccgtaagccgccatcggaagcgtgccgactgttttgccgacggcgtatgcttctgcagccaaaggaaaggcgtgacggacggtttcgccgttttcgccgaatcctgcctcatcatcactaccgacaaacagtccctccaacgcggcataacggctgtggcggatatttgccatcgtctgatagacgtgccgatacgacgcgccgttgcctaacattgcatagcctgccagcacgagtccggtttctttggtgtccgacacggcttcttccgcacctatatcggtaaacgttttcacataatcgtcgttggtggcgcgcacatatacgggcatattgggatacatggacagcacattgtctaaaacgtgttgcgtttcgtgcatattgttgagcgtaaccaccaccattttcgcccgtcccagaccggcggcttccaatacttccctgcgtttcgcatcgccgaacgacaccggttcgcccgcacttctggcaacctgcacccgcgcaatgtccaagtcgagcgcgaaatacggaatatcctcttgggcaaggacgcgtccgaccgtctgcccgcccctgccgaagccgacaatcagcacatggtcggacttgctcatggtttctaccagcatactgtgcagatcgagcgacttcatgtcccagcttgacttgaccaaacgcccgaccagcgcatcgctgccgcccaagaggaagggcgcgataatcatcgacagcagaaccgccgccgtcgccgcctgttcccattctggcgaaaccatatcaagctgcccggcaatggccagcatcacgaagccgaactcgccgccctgcgcgagatacaaagccgttttgaggctgtcgccgaccgaatgtttcattttgaaggcaatggcaaacacaaccagtgccttcaacaccagcagcattgccaacagcatcaatacctgccgccagccgccgatcaatgcctgaatgtccagcttcatgccgaccgtgataaagaaaaagccgagcaaaatatcgcggaacgggcggatgtcgtcttcgacttggaaacggtattccgtttccgaaagcagcatgccggcaacgaatgcgcccaacgccatagacaaaccttccagctcagtcagataagccacacccaaggttaccagcagcacattgatcataaagagttcggacgatttgcgttttgccaccatcctgaaccatcgcgacataattttgctgccgacgaaaaacagcagccccagcgtcagcagcatttttgcaaacgccaaacccaaggccgcccaaatatttccgtcccctccgcccgccagcgcgggaatcagaatcatcagcggcacgacggcgatgtcctgcatcagcagcacgcccatcgccatctgaccgtgcggctgccccaattccgtcttttccgacaaaatccggctcacaatcgccgtggacgacatcgccaacgcgcccgacacggcaaacgcccaattgaacggcacgcccgtcagcatcagtatgcccattaccgacagcatcgtaatgccgacctgcaaaccgcccagaccgaacaccagccgcctcatcgccctcaacttgggcagcgagaactccaaaccgatgctgaacatcaggaacacaatcccgatttcgcccaaataatccgtcgcatggcttttcggaatcaggctgagcataccgggccccgccaaaaagcccaccagcaggtagcccagcatggagggaatgttgaacttgcggcacaggatcaccgtaatgaccgacaccagcaaaacaatcacaataggggcaagcgaaaattcgttcatagaccgtccgaacaggaaaatacagaaaaatgccgtctgaaacggcatacgccgccgcattataacaaaacaccgcgcaccatccgaaacgggcgcggcatacaattctgctaaaatacgccctttcgattttgagccgcacaccgacatgaccgccacagccgccgccatagaccgcctgcttccccaaacccaatgccgcgaatgcggctacgacggctgcctgccctacgcacaggcagtcgcaacaggcgaagcgtacaacctctgcgccccgggcggagaaaccgtcattcgggacatttccgccctgctcggcaaaccctttgtcgcacctgccaaaacccaagccaaagcactcgcccggatagacgaaaccgcctgtatcggctgcaccgcctgcatccgcgcctgccctgccgatgccattatgggcgcgggcaaacttatgcacaccgtcatcgccgacgaatgcaccggctgcggactctgcgtcgccccctgccccgtcgactgcatccatatgcagcccgttgccgacaccgtcctgccccgcgcgcgccgcttcagcctgtccgccgacagccgttttgccgccgccgaacacgcgcgcacgcgctacctcaaacgcaacgaacgcaaacagcgcgaagccgacgaacgcaaggccatgcttgccgaacgcgaagccgccgtccgcaacgcgcgtccgcaaacgcccgacacaccgaaaaaaccgacgtttaaccctgccgacctcatcgccaaagccatggcaaaagcgcaaacccaacaagaccgcctcgccgccgccgacaaccgcaaagactatcaggcgaaacagatagccgaagcccgcgaacgcgccgagttgcgccgcgcccaacgcgatatgaaatacggcagcgacagcgaaaaagccgccgccctcgaatatctcaaacaatacaaagccaaacaggaagccgcacagaataccgcctcctgacccttccctgatatgccgtctgaagccgcttcagacggcattttatcaagctctccgtccgccgcacccgtgccgtccgcatcttaccgcccacccttccggccgcgccgttttcaataaaatattaattacacgccactacaaatttgctataatccgccccgaaaatctacccaaccctcaacaaaggaacaaaccatgggcatcaaagtcgccatcaacggctacggacgcatcggccgccaggttttgcgcgccatctacgattatcagattcaagaccaactccaamtcgtcgccgtcaacgccagcggcagccttgaaaccaacgcccatctgaccaaattcgacaccgtgcacggacgctttgaagccgacgtatcccacgacggcggcaacctcatcgtcaacggcgacaaaatccccttcttctcgacccgcaaccctgccgaactgccgtggaaagaactcggtgtcgatttggtcatggaatgcaccggcgcgttcaccagcaaagaaaaagccaaaatccacctcgaaagcggcgcgaaaaaagtcctcatttccgcaccgggcggcgacgatgtcgatgcaaccgtcgtgtacggcgtgaacgacagcgtcctgaccgccgacatgaccgtcgtttccaacgcttcctgcaccaccaactgcctctcgccggttgccaaagtgttgagcgaaagcgtcggcatcgtcaaaggcgcgatgaccaccatccacgcgctgaccaacgaccaaaccgttaccgacgtgcgccacaaagacctgcgccgcgcccgcagcggcgtggaaaacatgattccgaccaaaaccggcgcggcaaaagccgtcggtttggtactgcccgaattgaaaggcaggctcgacgggcttgccatccgcgtgccgaccgtcaacgtatcattggtagatttgagcttccaagccgcgcgcgacaccacagtcgaagaaatcaacgcactgatgaaagccgcctcggaagcaggcccgctcaaaggcgttttgggctacaacaccctgcccttggtttccatggacttcaaccacactaccgaagccagccacttcgacgcaacactgaccaaagtcgttgacggcaacatggtcaaagtgttcgcttggtatgacaacgaatggggcttcagctgccaaatgctgaacaccgcacgccgtatgttcggacttgaagtgcgcccgctcaaataagcaacaaaccgtcaaacaaaatgccatctgaaacccgatgttttcaagtttcagacggcatttttcattttcaccgtgattttatccggctgtcgtcatttctaattttatagtggattaacaaaaaccagtacggcgttgcctcgccttgccgtactatttgtactgtctgcggcttcgtcgccttgtcctgatttttgttaatccactataatccaccatatttgaacctgaccggagcataagccgccatcaaagccccttgcacgccacttcgcgccgcccgatttcctctttcaacggcacggcgttcaacatccgcagacgttcggcaaaatccgcaaacggcagcagctccgaaccgaaacggcgcatatgttccgtatcctgctggcagtctatcagttccacgcccaaatccgccaaaaacggcacggcgcaggcaaacgcgattttcgacgcatccggttgtaatgcgaacatcgattcgccataaaacaccctgccgatctgaacgccgtaaaagccgcccgccaacctcgtttcaccgctttcatcgggataatggcactcgaaagaatgcgcgtaccccatttcgtgcagcttcaaatatgccgtctgaaactcgggcgcaatccaagttccgtcctgattcgggcgcgccgctgccgcacaatgcgcgaccacttccgcaaaacagccgttgaccgcaacccgatagctgccgttgcgcagcgttttcgccagcgagcgcggaatatgcagcctgtcgggaaacaccaccgcacggggcccgaccgcataccaaaaaaaccacccgtcccgggaaaaccacggaaacacgccgttccgatacgcctcaagcagccgccccgcatccaaatcgccgctcacgccgaccagcccgtcgcaccgggccaaagcataggcaggatcgggaaaggcataattgtcaggggcaagcagcggaatacgcatgacagttctccaaaaacacaggcggcatccaaaatcatgaatgccgtctgaacaacaaaccgtccggatttaacgtttgcccttggcctgacagtcgctgcacacgccgtacatataaagcgcgtgatcgacgatgcggtagccgttttcttccgcgattttgtcttgcagggcttcgatttcgggattgtggaattccgttacctcgccgcacttcacgcagacgatgtggtcatggtggtcgcctttgtccaactcataaaccgccttgcccgtttcaaaatgatggcgttgcaaaatgcccgcctgctcaaactgggtcagcacacggtaaatcgtcgccacaccgatttccacaccctcttccaacaaaatgcggtacacatcttccgcactcaaatgctcttccgcatgcgtctcgaacaaatccaaaatcttcaaacgcgggccggtaaccttcagaccgctgtctttcagttgtgcaatattgttgaatttttccataatattcaatacccctgtaaaacaatagacgttataatacgcaatttcggcctgtttgcccactatcgcaccatagcagtttgcaatagtaaaaccgcaccggcggccgatgcgcggacagggcggataccgcttaatcgtatgattatcgttcgcttttataaaatattcaagcagtgttacactacccatcccgatttgcacagaaaggcatttccgtgaacaaaaccctcatcctcgccctttccgccctcctcggccttgccgcgtgcagtgccgaacgcgtttcactgttcccctcgtacaaactcaaaatcatacagggcaacgaactcgaaccgcgcgccgttgccgccctccgccccggcatgaccaaagaccaagtcctgctcctgctcggcagccccatactgcgcgacgcattccataccgaccgctgggactataccttcaacacctcccgcaacggcatcatcaaagaacgcagcaatctgaccgtctattttgaaaacggcgtactcgtccgcaccgaaggcgacgtcctgcaaaacgctgccgaagccctcaaagaccgccaaaacacagacaaaccataaggaacacacatgacaccgctcaaaatcgccatcgccggcgcaaacggccgtatgggacgcgtattggttgaagccgtcaacaaccatcccgacaccgtcctttccggtgcgcttgaacactcaggctcagaagccctcgggctggacgcaggctacgccgtcggactcaaaaccggcatcgccatttcagacgacgttgacgccgttctcgcacaaagcgacgtactcatcgacttcacccgccccgagcccaccctcaaacacctgcaaaaatgcgttgaaaaacaagtcaacatcatcatcggcacaacaggcttcgacgatacgggcaaagccgctatccacactgccgccgaaaaaacaggcatcgttttcgccgccaacttcagcgtcggcgtcaacctcaccttccacatcctcgacaccgtcgcacgcgtattaaacgaaggctacgacatcgaaatcattgaaggccaccaccgccacaaagtcgatgcccccagcggcaccgcgttacgcatgggcgaagtcatcgccggcgcgctcggcagagacctcaaacaatgcgccgtttacggccgcgaaggccacaccggtccgcgcgatccgtcgaccatcggctttgccaccgtccgcgcaggcgacatcgtcggcgaccacaccgccctcttcgccaccgacggcgagcgcgtggaaatcacccacaaggccagcagccgcatgacctttgccgccggtgccgtccgcgccgcagtttgggtcaacggcaaaacgggtttgtacgatatgcaggacgtactcgggctgaacaaccgttaacccccatacaaaatgccgtctgaaaagatattgttcagacggcattttgccgacaggctccgtatcggcatatcaatgtttcaacacacaggacgacacataaagcgtcgccctatgtgttgccctgattcggaaggggttacgcccctcccaaataaaatctgattctaccgccccgaaggacagatgtccgagtggcggggtttcaaccgaaaaggaaatacgataaagttgcctgctcagcataacaagctacggctcgtttaattgaaactctcctgatctaaaaattctaactctatttcccggcaaactatatctatactaaaaccggtcggaagatcatacctactgcctatcacttccagcgcacctccataatccaagatttcatcatcctgctttaattctccaagttccaatacatttttgatatttttatcttggttcttcgtggcgtatccatagataaatttcagatagctgaactgcttgaatttaatttttacccagtctgtataatttggtgtaggaatctcttgaggaaagtccggataatccacattctggacgatgatatggaattcatcgtttttcaaagtatagtttaatagagtgccctcatatatatacagaaattgataatctttttttggaatggtataagttgtcatattattttaccttttcaaaaacaatgagtttaagattttttgagtccaagttggttctactactcttatgaaatttcagttgtttaaactcttcctttattttaaggaatttttcaactagccgagaacaaactggagcaaaatggacgattgagtttaggaatcaacctgattcagtacatgggcaaagattagaattaaaatttagataaaggttacgttatgaatgtgaagataaaatataatcttttagaatattgtgaatatttaggtggtatttttggtgtttataaaaattatttaaatatggatatcaaagatccaaatttaaaaattagattttttgattttttggaagaacttttatcagatggtgttattgaattatgcgattatcgtgaaaatcctccaaaaatattaactggttcgccaaaaacacaggtagatgaattaagaagaatttggccggatatggaagagatgttgctatattttccagataatccttggttttatgtagaacatttttggtggggagcaacttgccctattgaactgacacaattgcctaaaatagaaatttacgaagaacaaatgaaacaaggtaagtaagcgtattagtataagctataatcataaatcatatataacaaaattaatcagttaactgaccattatattttaaccttaatcccattcgggccagttctgtttcatttggaattcctcttaaatacttattgtttgatgtgccattaatcacaatttctccccctttttttgtaatacgtgctgcttcgggaaaataatccattaaccgctcaacatcccgcctcttccaaaaccgcgcgcgcggccaaatccgccgtatcttttttcaacagcaggtgcaacgccctgaaatcctgttgcagcgcggcaaccttatcggggtgttcgtaccagtccgccaacgccgccgccagtttttccggttttgcttcagattgcaataattccggcacagcctccttacccaacaggatattcggcaggccgacatgcggcactttgattttgcgtttcacataagcataggtcagcggcgaaatcttgtagctgatgaccatcggacgcttacacaacgccacctccaaagttgccgtaccgctcgttaccagcaccgcatccgccgccctgcacactgtttcagactgtctgtcgattaccgtcagcggcaatccggcaaactccggccgctgcaaaacttccgccaaacgccgcttcgtcgcctccgttgcggcaggcagcaggaagcgtgcggcgggatagcgttccaacaacaataatgccgtctgaaaaaacaccggcgccatatagtcgatttcgctgacgcggctgccgggcagcagggcgaatacggggatgccggcatccacgcccaaagtttgccgcgccgtttcacggtcgtcttccaagggcataagctgcgccatcggatgaccgacaaactccgcacgtccgcccgcatcgagataaagctgcggctccatcgggaacaggcacaacacgcggttgacctgatgcacgattttgcccacacgttcccgccgccacgcccacaccgacgggctgacataatgcacggtcggaatccccgaccgtttcagcttttccgccacacccaaattaaaatcgggcgcatcgataccgacaaagacatcaggtttcaacgacagcaaatcccgtaccagccccctgcgtatccgtaaaatttccggcagccgcctgaccacttcgacaaagccgcgcaccgccagccgctcctgatcataaaggctctcgaaaccttccgccttcatcagttcgccgccgataccggtaaaccgcgcctgcggacaacgcttgcggatggcgcgtatcaggtgcgcccccaataggtcgcccgacgcttcgccgacactgacggcaatcaaagggctttttttatcagccatattcgtctgtccccacatactttcacgtcccgatgccgtctgaaggcttcagacggcatcggggttcacattttcgtcccgttttccaacatcaccgcaaactgcgccaagtccggcggcagctccgccttcaacaccagcggctcgcccgtgagcggatggttcaagtgcagctcggacgcgtgcaaaaacatccgcttcaaacccaacttctgcaaacgacggttcgcctgataatcgccgtagcgttcgtcgcccgcaatcggacagccttgagattgcaggtggacgcggatttggtgcgtgcgccccgttttcaacgtcgcccgcaccaaagtcaggtgcgacagcccgacaccgtgcaaaatgccgtctgaaaaacggcttaacacacggaacaccgtatgcgccgactgcccgtccgcactgacgcgcaccatcttttcgccttgtgcgccggtatatttgaacaggggcagtttgacatggaaattgtcgtccggcagtttgcccacccccagcgcaaggtagatttttttggggtggtcgttacggatggcttcgtgaagtttgacgagcgcgctgcgtttcttcgccaccatcaacaagccgctcgtatccttgtccaaacgatgaaccaactccaaatacttcgcctccggacgggcgcggcgcaactgttcgataacgccgaaactcacgccgctgccgccgtggacggcaacgccggacggtttgtcgatgaccaaaagcgcatcgtcttcgtaaacaacgtcaaacgcacgcgccggtacggcggcacgcctttcagacggcatttccttctccgccacgcgcacaggcggaatccgcaccgtatccccctccgcaatacggctgtcgggtttgcagcgtttcttgttcaaccgcacctcgccggcgcggataatgcggtggatatggctcttgggaacacccttgaggatttttatcagatagttatcaaggcgttgacccgcctcatgttcggcaacccctatcaagctgaccgaatctttgcttatttcgtgcgttttcatctataatccgaacatccgtttcagcaaaaagcgcgcccgccgcgcctcctgaaacggtttactttaaaacggaattttatattaaaaacgcactccgcaaagcattttccctgcgcctgttcccagccggcaggcgcagaacgtaatcaagtttgaattgattttgccgtttcggcgcggaagtaagacggcagccgggcccaagtcccaaacgcaaaccgcccaaaacacaggcatcacgataacaagaagaagccggcccccatttttccgaccgcagcgttcggaacgcggcagacaaaccgccgcatcgatctttatagccttctgtatccgacccttccgcacacggttctccggaacgtgcatccctgcggattttcaactcaaaaactgattaccggttttatccgaaaacatcggaaaacccagccttacggaatgccgaaccgggcatgtgccgtctgaacgccgcctgcccacgaggtgatcatgaaaagaatgttatttaacgcaacgcaggccgaagagctgcgcgttgccatcgtcgacggacaaaacctgctggatttggacatcgaaacgctgggcaaagaacagcgcaaaggcaatatctacaaaggcatcattacccgcatcgagccgtcgctggaagcgtgtttcgtggattacggaaccgaccgccacggcttcttgccgtttaaagaagtctcccgctcatacttccaagactacgaaggcggacgcgcgcgcatccaagacgtgctcaaagaaggcatggaagtcatcgtccaagtcgaaaaagacgagcgcggcaacaaaggcgccgcgctgaccaccttcatcagcctcgccggacgctatctggtattgatgccgaacaacccgcgcggcggcggcgtatcccgccgtatcgaaggtgaagagcgtcaagagttgaaagccgccatggcggaactcgacattccgaacggcatgagcatcatcgcccgtaccgccggcatcggccgcagcgcggaagagttggaatgggacttgaactacctcaaacaactctggcaggcgattgaagaagcaggaaaagcgcatcacgacccctacctgctctttatggaaagctcgctgctgatccgagccatccgcgactatttccgccccgacatcggcgagattttggtggacaatcaagaagtttacgaccaagttgccgagttcatgagctacgtcatgccgggcaatataggccgtctgaaactctacgaagaccacacgccgctgttttcccgcttccaaatcgaacaccaaatcgaaagcgcgttttcgcgcagcgtcagcctgccctccggcggcgcgatcgtcatcgaccataccgaagccctcgtctccatcgacgtgaactccgcacgcgccactcgcggcgcagacattgaagacaccgcgttcaaaaccaatatggaagccgccgaagaagtcgcccgacaaatgcgcctgcgcgacttgggcggcttggtcgtcatcgacttcatcgacatggaaaaccccaaacaccagcgcgatgtggaaaacgtcctgcgcgacgcgctcaaaaaagaccgcgcccgcgtgcagatgggcaaactctcccgtttcggacttttagaattgagccgccaacgtttgaaaccggctttgggcgaaagcagccacgtcgcctgtccgcgctgcgccggcaccggcgtgattcggggcatcgaatccaccgccctgcacgttttacgcatcattcaagaagaagcgatgaaggacaacaccggagaagtgcgcgcacaagtgcccgtcgatgtcgccaccttcctgctgaacgaaaaacgcgccgagctgtttgcgatggaagagcgtttggatgtcaacgtcgtcctgattccgaacatccacctcgaaaatccgcactacgaaatcaaccgcatccgcaccgacgacgtagaagaagacggcgaaccgagctacaaacgcgtcgccgagccggaagaagacgaatccgccaaaccgttcggcggcgaaaaagccaaagccgcccgtcccgaacccgccgtcaaaggcgtgcgccacaccagccccgccccgactgccgcccccgagaaaaaaacctcttggtgggacagcttcaaagcatggctcaaacgcattttcggcggcagcgaaacccaagccgcgcccgctgccgaaacctccgaaaaacgcagcacggcaaaccgcagcggcagccgcgccaacaaccgccgccaaaacccgcgccgcagcaaacgcgaaggcagcaaagtagaagtccgcgaagtggcaggcaaaactgccggacaggaagcgcgtgccgacaaagccgaaacgcgcaacaacggcaaccgccgccgcaatgaacgcggcgaccgtgccgccgaacgcgccaacgaagcggaaatccaaagccgcaacgtacagcctgccgcaaccgttgcagatgccgcaccgtccgaaaccgaagtgcaaaccggaaaacgccgccgcaacggcagccgcagcgaacgcggccaaaccgcgccggaaaccgccaccgttgccgaaacaaccgttcagacagcggaaaacacgccgtccgaaccgcataccgcagaagacaaaggcagcaagcccaaatccgaacgcaaccgccgcgaacgcgacagccgagatgccaaagaacgccgcgagcgcaacaatcagcgcgaccgccgtcaaaacggcaaaaaacgcaatattccgtctgccgccaaaatcgagcagtacctgaatattcacgacaccgccgacaaagtccgttccgccgccgcgcacgttttcggcgaaaccgacgcaaacgcgccgattactgtcagcattgccgatccggttgcagaaagggatcttccgacagcatctcccgccgtttcaaacggcgacgcaccggtttatgatgcggcggaaaaaatccgccgtgccaccgccgccatcctgcccgaaggcgcgacaccgaaagccgaagcacaggaaatgccgtctgaaaccgcaacctttacggctgcggcggaacaggcacgggaaaccgcacaaaccggcggactcgtcctgatcgaaaccgaccctgccgcattgaaggcatgggcggcacaacccgaagtccaagccggacgcggtttgcgccgttccgaacagcccaagccgtctgaagtcgcaaccgtccctgccgaagaaatgatccaagtcgaaacccggcaaggctgaaccgacggcggcaaaaagaggttctgttccgcagaacctcttttttacatgggttcggatacctgcaatgccgtctgaaacttcgccattcccgtgattaccgaaacattccgccattcccatgattcccgcaacattccgtcattcccatgattcccgcaacattccgtcattcccatgattcccgcaacattccgtcattcccatgattcccgcaacattccgtcattcccgtgaaaacgggaatctagaacctcaaactttcggataatctttgaatattgccgtcgcccaaaggcctggattcccgcctgcgcgggaatgacggcggagggtggacgatgccgtctgaaacttcgccattcccatgattaccgcaacctttcgtcattcccgccacctttcgtcattcccgtgaaaacgggaatctagaacctcaaactttcggataatctttgaatattgccgctgcccgaaggtctggattcccacaacctttcgtcattcccgtgaaaacgggaatctagaacctcaaactttcagataacctttgaatattgccgctgcccgaaggtctggattcccacaacatttcgtcatttccgtgaaaacgggaatctagaacctctaaactttcagataatctttgaatattgccgtcgcccaaaggcctggattcccgcctgcgcgggaatgacggtttagaagttgcccgaaacctcaaaaaaaaccgaaaccgaacaagccggattcccgcaacattccgtcattcccgtgaaaacgggaatctagaacctctaaactttcagataatctttgaatattgccgctgtccaatggtctggattcccgcctgcgcgggaatgacggtttagaagttgcccgaaacctcaaaaaaaccgaaaccgaacaagccggattcccgcaacattccgtcattcccgtgaaaacgggaatctagaacctcaaactttcagataatctttgaatattgccgctgtccaatggtctggattcccgcctgcgcgggaatgacggtttagaagttgcccgaaacctcaaaaaaaaaaaccgaaaccgaacagaccggattcccgccacctttcgtcattcccgtgaaaacgggaatctagaacctcaaactttcggataatctttgaatattgccgctgtccaatggtctggattcccgcctgcgcgggaatgacgatttggaaattacccgaaacccaaaaacaactgaaaccgaacagaccggattcccgcctgcgcggaaatgacgggtcttttatcatctttaaaggctgccgcgcgccatctcgacggcggtctccacggcagttatcaggctgccggaatccgccctgccggttgccgccaaatcaagcgcggtgccgtgatcgacggaggtgcggataaagggcaggccgagcgtgatgttcacgccctgtccgaagctgtggtatttcaacacgggcagcccttggtcgtggtacatcgccaatacggcatccgcaccttcgagcataaacggctggaacaatgtgtccgccggatacgggccggcaaggtttatcccttcgcggcgcaggttttccaatgcagggataatggtgtcggtttcttcgtgtccgaggtgtccgccttcgccggcgtggggattaagtccggcgacaaggattttgggatttttgatgccgaatttgtgttttaagtcgtgatgcaaaatgcgtgcgacgctttcaatcagcggttgcgtgatggcggcggcaacgtctttcagcggcaggtgggtcgttacgagggcgacgcgcaggcctttgccggcaagcatcatcacgacctgccccgtgccgcttttttccgccagatattcggtgtgtccgctgaaaaaacctgtgcttgcgcgcgcgtcgttgatgatgcctttgtgcagcggcgcggtaacgatgccgtcgaaaatgccgtctgaaatgcctgcgagcgcggtgtccaaaagttgcagcacataggcggcgttggcgggattgagtttgcccgcctcaaccgcttcgacggcagggatgtgcagcacttccagctcgccgtatgccgcgccgcctgattctggatcgaagtcgcgcaggacgacgcttttgcccaaggcttcggcgcgcgcgcgcaataggtttttgtcgcccaataccgcgcagcggcagggcaggcgtgcaaacgccaagtccaaacaaatatcggggccgatgccggcaggctcgccggaagtaacggcaaaaacaggctgtttcatcgtgtttgctccaaacaaaatgcgattctaacgccgcagccgcgcggcgatgtaaatttttctgattttgttgacaatctgctagaatgggcgtttacaaaatttaaaccctgcttgcataccgccaatatgtgcgagtttcaactttaaggaagcgatatgaacgagaactttaccgaatggctgcacggctgggtcggcgccatcaacgatccgatgtggtcatacttggtttatatgcttttgggtacggggcttttcttcaccgtaaccacgggctttgtccaattccgcctgttcgggcgcagcatcaaagaaatgctcggcggccgcaaacagggggacgaccctcacggcatcacgccgtttcaggcatttgtaaccggccttgccagccgcgtgggcgtgggcaatatcgcgggcgtggccatcgccatcaaagtcggcggaccgggcgcggtgttttggatgtgggtaaccgccttaatcggtatgagttcggcgtttgtcgaatcttcgctggcgcagctctttaaagtccgcgactacgacaaccaccatttccggggcggccctgcctactacatcactcaagggctggggcagaaatggctgggcgtgttgttcgccctgagcctgattttctgtttcggctttgtgtttgaagcggttcagaccaataccatcgccgataccgtcaaagcggcatggggttgggagcctcattatgtcggcgtcgccctggtgattttaaccgcgccgattatcttcggcggcatcaggcgcatatctaaagcggcggaaatcgtcgtccccctgatggcggttttgtacctctttatcgcgcttttcatcattttgaccaatattccgatgattccggacgtgttcggtcagattttttcgggcgcgttcaaattcgacgcggcagcaggcggcttactcggcggtctgatttcgcaaacgatgatgatgggcatcaaacgcggcctgtattccaacgaggcgggtatgggttccgcgccgaacgccgccgccgccgccgaagtgaaacaccctgtttcgcaaggtatgattcaaatgctgggcgtgtttgtcgataccatcatcgtttgttcttgcaccgccttcatcatcttgatttaccaacagccttacggcgatttgagcggtgcggcgctgacgcaggcggcgattgtcagccaagtggggcaatggggcgcgggcttcctcgccgtcatcctgtttatgtttgccttttccaccgttatcggcaactatgcctatgccgagtccaacgtccaattcatcaaaagccattggctgattaccgccgttttccgtatgctggttttggcgtgggtctatttcggcgcggttgccaatgtgcctttggtctgggatatggcggatatggcgatgggcattatggcgtggatcaaccttgtcgccatcctgctgctctcgcccttggcgtttatgctgctgcgcgattacaccgccaagctgaaaatgggcaaagaccccgagttcaaactttccgaacatccgggcctgaaacgccgtatcaaatccgacgtttggtaaatcccgcccttaccggagccgcttccccgcgaagcggcttttccctttccgcacactgtaaaaacagggcgaacaagcgtacaatcccaaccctttacttttgaatccatttcgtttttcagacggcatattgaatatagtggtttaacaaaaatcaggacaaggcgacgaagccgcagacagtacaagcagtacgaaaccgattcacttggtgcttcagcaccttagagaatcgttctctttgagctaaggcgaggcaacgctgtactggtttttgttaatccactataaatgccgtctgaaacaccgtcaggcaatacacactatgacccacatgatttaccccaaaacctacgacgttatcgtcgtcggcggcggacacgccggcacggaagccgcactcgccgccgcccgtatgggcgcgcagacgcttttgctctcacacaatatcgaaacgctcggacaaatgtcgtgcaacccctctatcggcggcatcggcaaagggcatttggtgcgcgaactcgacgcgctcggcggcgcgatggcgttggcaaccgacaaatccggtatccagttccgccgcctgaacgccagcaaaggcgcggcagtgcgtgccacgcgcgcgcaggcggaccgcatcctgtacaaagccgccatccgcgaaatgttggaaaaccaagaaaacctcgaccttttccaacaagccgtcgaagacgtaacgctcgacggcgaacgcatcagcggcgtaattaccgcgatgggcgtggagtttaaagcacgcgccgtcgtgttgaccgcaggcacgtttttgtccggcaaaatccacatcggtttggaaaactacgaaggcggacgcgccggcgaccccgccgccaaatcgttgggcggacgtttgcgcgaattgaagctgccgcaaggccgtctgaaaaccggcacgccgccgcgtattgacggacgcacgattgacttctcccaactgaccgaacagcccggcgacacgcccgttcccgtcatgtccgtgcgcggcaacgccgatatgcacccgcgccaagtgtcctgctggattacgcataccaacacgcaaacccacgacatcatccgctcaggcttcgaccgcagcccgatgtttaccggcaaaatcgaaggcgtgggtccgcgttattgtccgtctatcgaagacaaaatcaaccgcttcgccgacaaagacagccaccagattttcctcgaacccgaaggtctgaccacgcacgaatactatcctaacggtatctccaccagcctgccgttcgacatccaaatcgcgctcgtccgcagtatgaaaggtttggaaaacgcccatatcctgcgccccggctacgccatcgaatacgactacttcgatccgcgcaacctcaaagcaagcctcgaaaccaaaaccattgccggattgtttttcgccgggcaaatcaacggtacgaccggctacgaagaagccgccgcgcaaggtttattggcaggcgcgaacgccgtgcaatatgtgcgcggacaagacccgctcctgctgcgccgcgaacaagcctacctcggcgtattggtggacgacctcatcaccaaaggcgtgaacgaaccctaccgaatgttcaccagccgcgccgaataccgcctgcaactcagggaagacaacgccgacatgcgcctgaccgaagacggctacaaaatcggcttggtgtccgaagcgcaatggcgcatgttcaacgaaaaacgcgaagccgtcgaacgcgaaatccaacgtttgaaaacaacgtggtacacgccgcaaaaactcgccgaaggcgaacaaatccgtgtgttcggacaaaaactcagccgcgaagccaacctgcacgacctcctgcgccgcccaaacctcgactacgccgcgctgatgacgctcgaaggcgcgatgccgtctgaaaacctctccgccgaagtcatcgaacaagtcgaaatccaagtcaaataccaaggctatatcgaccgccaaaacgaagaaatcgacagccgccgcgacatcgaaaccttaaaactgcccgacggcatcgattacggcaaagtcaaaggcttgtcggcagaagtgcagcaaaagctcaaccagcacaaacccgaaaccgtcggacaagccagccgcatttccggcgtaacccctgcggcagtggcattgctgatggtgcatttgaagcgcgggtttaaagacgcgaaataaacacatcggcgcgatgccgtctgaaacccttttcagacggcattcccaccatcccgacaggaaacatcatgcacatactgaccgccggcgtggacgaggcaggacgcggacctttagtcggcagcgtgtttgccgccgccgtcatccttccggaaacattcgacctgcccggactgaccgactccaaaaaactcagcgagaaaaaacgcgacgcgcttgccgaaatgataaaaaatcaggcggttgagtggcacgttgccgccgcctcgcccgaagaaatcgccagcctcaacatcctgcacgccaccatgctcgcgatgaaacgcgccgttgacggcttggctgtgcgtcccgaaaaaatattcatcgacggcaaccgcattcctgaacatttgaacatccctgccgaagccgtcgtcaaaggcgacagcaaaatcatcgaaatctccgccgcatccgttttggcaaagaccgcacgcgatgcggaaatgtacgcactggcgcaacgccatccccaatacggtttcgacaaacacaaaggttacggcacgaagcagcatttggaagccctcgaaaaatacggcgtgctgcccgaacaccgccgcgacttcgcccccgtcagaaacctgctcgcgcagcaggccttgttttaaaccggcacaaaaatgccgtctgaagccttcagacggcatttccggcatcgcaactccaaagagaaagaacccaaaccgtcattcccgcgaaaaatagaaaatcaaaaaaaaaacctaaaatccgtcattcccgcgcaggcgggaatccaatccgtccggtttccgttttttttttgaatttcaggtaacttccaaaccgtcattcccgcgaaagcgggaatctagaaactcaaagctgcaagaatttatcaaaaatgactgaagctcaaaaaaccggattcctacgaaaacaggaatccggagtctcagggctggcaaaaccgttttacccgataagtttccgtaccgacagacctagattcccgccttcgcgggaatgacgaaattttagattgcaggcatttatcggataaaacagaaattaagcgtgacgaaaatttatccgaaatcacagcaacttttccgcgtcattcccgcaaaagcgggaatctagaaactcaaagctgcaagaatttatcaaaaatgactgaaactcaaaaaaccggattcccgcgaaaacaggaatccggagtctcaggtttggaaaaaccgtttttcccgataagtttccgtaccgacagacctagattcccgccttcgcgggaatgacgaaattttaggcttctgttttgattttttgtttttgcgggaatgacgaaattttagattgcaggcatttatcggataaaacagaaattaagcgtgacgaaaatttatccgaaatcacagcaacttttccgcgtcattcccgcaaaagcgggaatctagaaactcaaagctgcaagaatttatcaaaaatgactgaaactcaaaaaaccggattcccgcgaaaacaggaatccggagtctcagggttggaaaaaccgtttttcccgataagtttccgtaccgacagacctagattcccgcctgcgcgggaatgacgatatttcagttttgtgtttttgatttttttgtttttgcgggaatgacgataaatgacgatataagtatttttattttaatccgccatattatagtggattaacaaaaaccagtacggcgttgcctcgccttagctcaaagagaacgattctctaaggtgctgaagcaccaagtgaatcggttccgtactatttgcactgtctgcggcttcgtcgccttgtcctgatttttgttaatccactataacgcacccggccaaacagcataaaggcacgggcagcccgatttggattgacctatttccccgacaccctcgccgccagctcgtccgccaaggcaagatacgccttggtaccctttgcctgcgcgtcgtaagccatcaccggcataccgtggctcggcgcttccgcaaggcggatattgcgcgggatgacggtttcaaaaagcaaatccccgaaatggctgcgcaactgttcgctgacttcggcaaccagcctgctgcggctgtcgtacatcgtgcgcacgatgcccgtgatgtccaaatcgggattgaccgcctgacggattttgcgcacggtcgcaatcaaatcggaaatcccttccagcgcgtaatattcgcacaacatcggcacaatcacgccgcccgccgccaccagcccgttaagcgtcaacagcgtcagcgaaggcgggcagtcgatcaggataaagtcgtaatcttcttccactgccttgagcgcgtttttcaaacgcacttcccgggcgatttcctgcaccagttcgatttccgcgccggccagcgcgcggttcgcacccaacacagcgtatccgccctctttgctgcgtaccgccgccgactgcacgtccgcatcgcccaataagacctgataaacgccggactgcaaacccgccttgtcgatgccgctgcccgtcgtcgcattgccctgcggatccaaatcgaccaccagcacgcgtttgccgcgcgatgccagcgaagccgccaaatttaccgtcgtcgtcgttttgcccacaccgcccttctgattggcgatggcaaggatgttcgcactcatgtcccgcccgtgtcccgtctgatgttgaaaaaagaaaaacagtgcggaattttacctttatccgcacaaaaaaggtattcatgccgtctgaagtgcgctcaacgcttgctcaggatgacgatatggcgttccgcatccaagcccggcacgtcgagcctttggactttttcaacgcacacatcctgcggcaggcggccgatttcttcctgcggatacacgcccttcatcgccgcccagtagccgccgtctttcaacagatgcaccgtccacgacacaaaatccgccagttctgcaaacgcacggctggtaaccacatcggcacgcacgtccgaaaccgcctccacgcgtccggataccacgcgcacattgtccaaccccaactcgataaccgcctgctgtaaaaaagccgttttcttcgtattcgcatccaaaagggttatttgcacatccggacggcacaccgccgccggaatgccgggctgaccgccgcccgaaccgacatccagcatcgtttgcacaccctcgatatggggcagcagcgtcaggctgtccaaaagatgatggacaatcattttttcctcgtcgcgcagggcggtcagattgtaggttttgttccactttttcaacaaatccacatagaccaaaagcctgtcctgcgccgtttccgaaatatccagccccatcgcggcaatgcctgcacgcaggcgttctttgcgttccatatctgcttcctgtccatattcaggcgtaatgttagcggaaaaacatgccgtctgaaaccgcgtgtcgggtttcagacggcatttcccgttccaacctattttttcctgtgaaacaccaccggctgcaccggcgcgcgcgtcaggcgtttgggcagcgtcagcatcgccaccagccacacggcaaacgcatattccaacaccgcctcccccgcagcccgcccaaagccccactgccaagcagcagctcgaaaatccaagccaccgctgccgccgcgcaagccgccacgcccgacagaaacagtgtgtaacgcgaatgccgccgcatcatctttttgtacgccagtttcgtcagacccgccgacacaaccacattcaaaaacgcaaacacaccgaacacaaaccaaacagtgccgtcccaaccgccacgccagccgaatccgccgtccgacaccgacaccagcaaccccgtccgtccgaacgcaagcgcaaaggcatcatgcaccgccaacgcaaacggcagcgtcaaaaacaccagtcccgcaaacagagccgcataaggatatttctcgttcacaaacatcgccgtccccctcttccgaagcagaccgcattatatagcggattaacaaaaatcaggacaaggcgacgaagccgcagacagtacaaatagtacggaaccgattcacttggtgcttgagcaccttagagaatcgttctctttgagctaaggcgaggcaacgccgtactggtttttgttaatccactataccgcgcactgccttgccgcccgcccgaaaagttgcacaaacaaccgttcatatatatcatgacgaaaaaacgccggtgtagctcagtcggtagagcagcgcattcgtaacgcgaaggtcgggggttcgattcccttctccggcaccaataccaagcacagaccctcccttcctcgggaagcctgtgctttttcacatttccgcttcagacggcacaaccgatatgaacacctcgcaacgcaaccgcctcgtcagccgctggctcaactcctacgaacgctaccgctaccgccgcctcatccacgccgtccggctcggcggggccgtcctgttcgccaccgcctccgcccggctgctccacctccaacacggcgagtggatagggatgaccgtcttcgtcgtcctcggcatgctccagtttcaaggggcgatttactccaaggcggtggaacgtatgctcggcacggtcatcgggctgggcgcgggtttgggcgttttatggctgaaccagcattatttccacggcaacctcctcttctacctcaccgtcggcacggcaagcgcactggccggctgggcggcggtcggcaaaaacggctacgtccctatgctggcagggctgacgatgtgtatgctcatcggcgacaacggcagcgaatggctcgacagcggactcatgcgcgccatgaacgtcctcatcggcgcggccatcgccatcgccgccgccaaactgctgccgctgaaatccacactgatgtggcgtttcatgcttgccgacaacctggccgactgcagcaaaatgattgccgaaatcagcaacggcaggcgcatgacccgcgaacgcctcgaggagaacatggcgaaaatgcgccaaatcaacgcacgcatggtcaaaagccgcagccatctcgccgccacatcgggcgaaagccgcatcagccccgccatgatggaagccatgcagcacgcccaccgtaaaatcgtcaacaccaccgagctgctcctgaccaccgccgccaagctgcaatctcccaaactcaacggcagcgaaatccggctgcttgaccgccacttcacactgctccaaaccgacctgcaacaaaccgtcgcccttatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacggctgacggtcggacacgatgccgtctgaaacgcctgtcgcttcagacggcatccccaatccgcctaccttgtcgttatgcccgaataacggtactattcgcggttaacggtctttatgccgtctgaacggcttgaaacgcgttcagacggtctcccgcccaccttatcccaccgaaagaacaatatgatcaacgatattcaaaaaacagccgaaggcaagatgcagcgttcggtcgaagtactgaaagaaaatctggcgaaagtgcgtaccggccgcgcgcataccggcctgctcgaccaagtggaagtcgaatactggggcagcatggtccccgtcagccaagttgccaacgtaacgcttctggacgcgcgcaccatcggcgtgaaaccgtttgagggcaatatggcggccaaagtcgagaaagccatccgcgattcaaacttgggactgaacccggcagctgtcggcgacctgatccgcgtgccgatgcccatgctgaccgaggaacgccgcaaagacctgattaaagtcgtacgcggcgaagcggaagaaggccgcgtctctatccgcaacgtgcgccgcgatgccaacgaccacatcaaaaaactcctcaaagacaaagaaatttccgaagacgaggcacgtcgcggcgaagaagcggttcaaaaactgaccgacaaatacattaccgaagccgacaaactcctgactgccaaagaagaagatttgatggcaatttaacctgcacggttcggcgttcagacggcatttgaatgccgaaccgcgaaaggcagacatgaaaagcagcacgcaggccgttttggaacacaccgccattcccaagcatatcgccgtgattatggacggcaacggccgttgggcgaaaaaacgtttcctcccgcgcataatgggacacaaacgcggtttggacgcattggaaaatatggtgaagcattgcgccaaactgggtgtgcaatatctgaccgtgtttgccttttcaaccgaaaactggcgccgccccgaagacgaagtttcgttcctgatggggctgtttttacaggctttgcaaaaacaggtacgccgcctgcacgaaaacaatatgcgcctgaagatattgggcagccgcgaacgcttcaaccggcagattctgcaaggcatcgaagaggcggaagcgttgacggcaaacaataccggcctgaccctgagcattgccgccgattacggcggccgctgggatattttgcaggcggcaaacaaactgattgccgaaggcgtatccgagattacggaagacacgctggcgaaacacttgatgctgggcgatgcaccggaaccggatttgttcatccgcaccggcggcgaaacgcgcatcagcaatttcctgctctggcagatggcatatgcagaactgtatttcaccgatattttgtggcccgattttgacggcaaggctttggacgatgccgtcgcttcgttccaaaaacgcgaacggcggttcggacgcacctccgagcaactgcctatcgaacagcaaaggaactgaatatgctgaaacaacgggtaataaccgccatgtggctgctgccgctgatgctgggcatgctgttttacgcgccgcaatggttgtgggctgcattttgcggactgattgccctgattgccttgtgggaatatgcccgtatgggcggtttgtgcaaaattaaaaccaaccattacctcgccgcaaccttggttttcggcgtggttgcctatgcgggcggctggatgctgcctaatttggtttggtatgttgttttggcattttggctcgccgttatgcctttatggttgagattcaaatggaggctcaacggcggttggcaggtttatgccgtcggctggcttctggtcatgccgttttggttcgcgctcgtatccctgcgcccgcatcccgatgatgccctgccgctgctcgccgtgatgggtttggtgtgggttgccgatatttgcgcgtatttcagcggcaaggcgttcggcaaacacaaaatcgcgccggcaatcagccccggcaaaagctgggaaggtgcaatcggcggcgcggtttgcgtggcagtgtacatgaccgccgtacgaagtgccggctggctggcattcgatacaggctggttcgataccgtgttaatcggtttggtgctgaccgttgtcagcgtatgcggcgaccttttggaaagctggctcaagcgcgcggcaggcatcaaagacagcagcaagctgctgcccggacacggcggcgtgttcgaccgtaccgacagcctgattgccgttatcagcgtctatgcagcgatgatgtcggttttaaattgattctatgccgtctgaaaacgcttcagacggcatccggtataaagttatccccattatgacaccacaagtcctgaccatattaggcagtaccggcagcataggcgaaagcacgctggacgttgtctcccgccaccccgaaaaattccgcgtattcgcgctggcagggcataagcaggtcgagaaattggcggctcaatgtcaaacgttccaccccgaatatgccgtcgttgccgatgcggaacacgccgcccggcttgaagccctgttgaaacgcgacggcacggcgactcaggttttacacggcgcgcaggcattggttgacgttgcctctgccgacgaagtcagcggtgtcatgtgcgccatcgtcggggcggtggggctgccttccgcgctcgcagcggcgcaaaaaggcaaaaccatttatctggcaaacaaagaaacgctggtggtttccggcgcgttgtttatggaaaccgcccgtgcaaacggcgcggcagtgctgcccgtcgacagcgaacacaacgccgttttccaagttttgccgcgcgattacgccggccgtctgaacgaacacggcatcgcttcgattatcctgaccgcttccggcggcccgtttctgaccgccgatttaaacacgttcgaccgcattacgcccgcccaagcggtcaaacaccccaattggcgtatgggacgcaaaatctccgtcgattccgccaccatgatgaacaaaggtttggagctgattgaagcgcattggctgttcaactgtccgcccgacaaactcgaagtcgtcatccatccgcaatccgtgatacacagcatggtgcgctaccgcgacggctccgtgctggcgcaactgggcaatcccgatatgcgaacgcccatcgcttattgtttgggtttgcccgagcgcatcgattcgggtgtcggcgacctggatttcgacgcattgtccgcgctgaccttccaaaagcccgactttgaccgcttcccctgcctgaggctcgcctatgaagccatgaacgcaggcggagccgcgccctgcgtattgaacgccgccaacgaagccgccgtcgccgcctttttggacggacagattaagtttaccgacattgccaaaaccgtcgcccactgtcttgcacaagacttttcagacggcataggcgatataggggggctcttggcgcaagatgcccggacacgcgcacaagcgcgagcatttatcggcacactgcgctgatgccatctgaacaccgttatcaaaggaaaaccatttgcacacccttctagcttttatcttcgccatcctgattttggtcagcctgcacgagttcggacactacatcgttgccagattgtgcggcgtcaaagtcgtacgcttttccgtcggcttcggcaaaccgtttttcacccgaaagcgcggcgacaccgaatggtgcctcgccccgattccgttgggcggttacgtcaaaatggtcgatacgcgcgaaggcgaagtatcagaagccgatttaccctacgcttttgacaaacaacaccccgccaagcgcatcgccatcgtcgccgccggcccactgaccaacctcgcactggcggttttgctgtacggactgagcttttccttcggcgtaaccgaactgcgcccctacgtcggcacagtcgaacccgacaccattgccgcccgcgccggcttccaaagcggcgacaaaatacaatccgtcaacggcacacccgttgcagattggggcagcgcgcaaaccgaaatcgtcctcaacctcgaagccggcaaagtcgccgtcggcgttcagacggcatcgggcgcgcaaaccgtccgcaccatcgatgccgcaggcacgccggaagccggtaaaatcgcaaaaaaccaaggctacatcggactgatgccctttaaaatcacaaccgttgccggcggcgtggaaaaaggcagccccgccgaaaaagcaggcctgaaaccgggcgacaggctgactgccgccgacggcaaacccatcgcctcatggcaagaatgggcaaacctgacccgccaaagccccggcaaaaaaatcaccctgaactacgaacgcgccggacaaacccataccgccgacatccgccccgatactgtcgaacagtccgaccacaccctgatcgggcgcgtcggcctccgtccgcagccggacagggcgtgggacgcgcaaatccgccgcagctaccgtccgtctgttgtccgcgcattcggcatgggctgggaaaaaaccgtttcccactcgtggacaaccctcaaatttttcggcaaactaatcagcggcaacgcctccgtcagccatatttccgggccgctgaccattgccgacattgccggacagtccgccgaactcggcttgcaaagttatttggaatttttagcactggtcagcatcagcctcggcgtgctgaacctactgcccgtccctgttttggacggcgggcacctcgtgttttatactgccgaatggatacgcggcaaacctttgggcgaacgcgtccaaaacatcggtttgcgcttcgggctcgccctcatgatgctgatgatggcggtcgccttcttcaacgacgttacccggctgctcggttagattttacgtttcggaatgccgtctgaaaccgcattccgcaccacaaggaactgacaatgaaactgaaacagattgcttccgcactgatgatgttgggcatatcgcctttggcacttgccgacttcaccatccaagacatccgcgtcgaaggcttgcagcgtaccgagccgagtaccgtattcaactacctgcccgtcaaagtcggcgacacctacaacgacacacacggcagtgccatcatcaaaagcctgtacgccaccggtttctttgacgacgtacgcgtcgaaactgcggacgggcagctcctgctgaccgttatcgaacgccccaccatcggctcgctcaacatcaccggcgcaaaaatgctgcaaaacgacgccattaagaaaaacctcgaatcgttcgggctggcgcagtcgcaatactttaatcaggcgacactcaatcaggcagtcgccggcctgaaagaagaatacctcgggcgcggcaaactcaatatccaaatcacgcccaaagtaaccaaactcgcccgcaaccgcgtcgacatcgacatcacgattgacgagggcaaatccgccaaaatcaccgacatcgaatttgaaggcaaccaagtctattccgaccgcaaactgatgcggcaaatgtccctgaccgaaggcggcatttggacatggctgacacgaagcaaccaattcaacgagcagaaatttgcccaagatatggaaaaagtaaccgacttctaccaaaataacggctacttcgatttccgtatcctcgataccgacatccaaaccaacgaagacaaaaccaagcagaccatcaaaatcaccgtccacgaaggcggacgtttccgttggggcaaagtctccatcgaaggcgacaccaacgaagtccccaaagccgaactggaaaaactgctgaccatgaagcccggcaaatggtacgaacgccagcagatgaccgccgttttgggtgagattcagaaccgcatgggctcggcaggctacgcatacagcgaaatcagcgtacagccgctgccgaacgctgaaaccaaaaccgtcgatttcgtcctgcacatcgaaccgggccggaaaatctacgtcaacgaaatacacatcaccggcaacaacaaaacccgcgacgaagtcgtccgccgtgaattacgccaaatggaatccgcaccttacgacacctccaagctgcaacgttccaaagagcgcgtcgagcttttgggctacttcgacaatgtccagtttgatgctgtcccgcttgccggcacgcccgacaaagtcgatttgaacatgagtctgaccgaacgttccaccggttccctggatttgagcgcgggttgggttcaagataccgggttggtcatgtccgcaggcgtttcccaagacaacctgttcggtacgggcaagtcggccgcactgcgcgcctccaggagcaaaaccacgcttaacggctcgctgtcgtttactgacccgtacttcacggcagacggggtcagcctgggctacgatgtttacggaaaagccttcgacccgcgcaaagcatcgaccagcatcaaacaatataaaaccaccacggcaggcgcaggcatccgcatgagcgtgcctgttaccgaatacgaccgcgtgaatttcggtttggtggcagaacacctgaccgtcaacacctacaacaaagcgcccaaacactatgccgactttatcaagaaatacggcaaaaccgacggcacagacggcagcttcaaaggctggctgtacaaaggtaccgtcggctgggggcgcaacaaaaccgacagcgcgttatggccgacgcgcggctacctgacgggcgtgaacgccgaaatcgccctgcctggcagcaaactgcaatactactccgccacccacaaccaaacctggttcttccccctgagcaaaaccttcacgctgatgctcggcggcgaagtcggcattgcgggcggctacggcagaaccaaagaaatccccttctttgaaaacttctacggcggcggcctgggttcggtgcgcggatacgaaagcggcacgctcggtccgaaagtctatgacgaatacggcgaaaaaatcagctacggcggcaacaaaaaagccaacgtctccgccgagctgctcttcccgatgcccggcgcgaaagacgcgcgcaccgtccgcctgagcctgtttgccgacgcaggcagcgtgtgggacggcaaaacctacgacgacaacagcagttccgcgaccggcggcagggttcaaaacatttacggcgccggcaatacccataaatccacctttaccaacgaattgcgctattccgccggcggcgcggttacctggctctcgcctttaggcccgatgaaattcagctacgcctacccgctgaagaaaaaaccggaagacgaaatccaacgcttccaattccaactcggcacgacgttctaatcccgcaaatgccgtctgaagcccttcagacggcatttcgcggcaacattcgaaggagttttaccatgacccgtttgacccgcgcgtttgccgcggctctgatcggtttgtgctgcaccgcaggcgcgcacgccgacaccttccaaaaaatcggctttatcaacaccgagcgcatctacctcgaatccaagcaggcgcgcaagattcaaaaaacgctggacagcgaattttccgctcgtcaggacgaattgcaaaaactgcaacgcgaaggtctggatttggaaaggcagcttgccgaaggcaaactcagaaacgcaaaaaaggcgcaagccgaagaaaaatggcgcgggctggtcgcagcgttccgcaaaaaacaggcgcagtttgaagaagactacaacctccgccgcaacgaagagtttgcctccctccagcaaaacgccaaccgcgtcatcgtcaaaatcgccaaacaggaaggttacgatgtcattttgcagaacgtgatttacgtcaacacccaatacgacgttaccgacagcgtcattaaagaaatgaacgcccgctgaccctttcagacggcataccgaacaggaaaaccatgattccggccacctacaccctgtcccaaatcaccgcgcggctcggcggcgaatggcgcggcgaggacatttccgttaccgccgtgcgcccgctcgcagacgcgcaggcggaacacatcagcttccttgccaatccgaaatacaaagccgaagtccacgacagcagcgcgggcgcggtcatcgtttccgccaaagcggcagacggatttgaagggcgcaacctgattgtcgccgacgacccctatctctatttcgccaaagtcgcccgcctgttttcacccgtcgtcaaagcgcgcggcggcatccatccgaccgccgtcgtcgaaccgggcgcgaccgttcccaccagctgcgaaatcggcgcgaacgtctacatcggcgcaaacaccgtgctcggcgaaggctgccgcatcttggcaaacgccgtcgtccaacacgattgcaaactgggcgacgaagtcgtcctgcatcccaacgccgtcgtttattacggctgcacactgggcagacgcgtcgaaatccacagcggcgcggtcatcggcgcggacggtttcggactcgccttcgccgacgattcgtggttcaaaatcccgcaaaccggcgcggtaacgctgggcgacgacgtagaaatcggctcgaacaccaacatcgaccgcggcgcgatgagcgacaccaccgtcggcaacggcaccaaaatcgacaaccaagtccaaatcggacacaactgcaaaatcggttcgcacaccgtcatcgccgccaaaaccggcatctcaggtagcgtaaccataggcagctactgcatcatcggcggcggcgtcggtacggtcggacacatcgaaatcgccgacaaaaccaccatcggcggcggcacgtccgtcacccacagcattaccgaaagcggcaaacacctcgccggcatcttcccgatgtccacccataaagaatgggcgcgcaacgctgtttacatccaccgcttaagcgaaatgaacaaacggctcaaaacactggagcagcagctttcagatgccggtcaagacagcaaataaccaaaccgactttattcaaggaatacgacagacatggacgtacaactccccatcgaagccaaagacatccaaaaactcatcccccaccgctatccgtttctccagctcgaccgcatcaccgccttcgagccgatgaaaaccctgaccgcgattaaaaacgtcaccataaacgaaccccagttccaaggccatttccccgacctgcccgtgatgcccggcgtactcatcatcgaagcgatggcgcaggcgtgcggcacgttggcgattttgagcgaaggcgggcgcaaagaaaacgaattcttcttcttcgccggcatagacgaagcccgtttcaaacgccaagtcatccccggcgaccaactcgtctttgaagtcgagctgctgaccagccggcgcggcatcggcaaattcaacgccgttgccaaagtggacgggcaagttgccgtcgaagccatcatcatgtgtgccaaacgcgtggtttgagtgttcagaaaaaggtcgtctgaaagttttcagacaacctgttgccgtcgcgcatcttcgcggcaacacgacaggaaaggaaaaacatgaccctcatccacccgaccgccgtcatcgaccccaaagccgaactcgactccggcgtcaaagtcggcgcgtacaccgttatcggccccaacgtccaaatcggcgcgaataccgaaatcggtccgcacgccgtcatcaacggccacaccagcatcggcgaaaacaaccgcattttccaatttgccagcctcggcgaaatcccgcaggacaaaaaataccgcgacgagccgaccaagctgattatcggcaacggcaacaccatccgcgaattcaccacctttaatttaggtacggtaaccggcatcggcgaaacccggtatcggcgacgacaactggattatggcgta

SEQ ID NO: 37792 - DNA, 69876 bp, Neisseria meningitidis
atttcggcgagccgtagggtgggctgtagggtgggcttcagcccaccaatttcaccgcatcaaaggtttttgggaatacggcggtttcggttttcggtgggaatgggcggaatkgataacattgacggagttgggggaataggtggaaacggtgggattggtgggctgaagcccaccctacagccagccctatgtccacgctgcacatcctacgcccgccttgcgtttcttataagcagcattttacgcaatactttgcgtccgctgaaaaaatttcaaacggtcttttttatcaaatgcgaaaaatataacgtcattcccgcgcaggcgggaatctagtctgtcggtgcggaaacttatcggataaaacggtttctttagattttacgccctagatcccgtctgctcgggaataacgggatttgaggtttctgtttttgattttctgttttcgcgggaataacggtttagaagttacccgaaacctcaaaaaaaccgaaaccgaacggactggattcccgcctgcgcgggaatgacgggtttcgagattacggtgtatcggggatgatggaaaatggcggggattgtgtaaaaaatgccgtctgaagcctttcagacggcatttgcggcgtttggacgtttagaacttcatttccaagctaaatgtgtagttgcgaccgggggcggcatatcggttgtaaacgccgacatttttgtgttggttgactgcgccgccggcagtttgccgcacattttcccaagtaacatagcggtagttgaggaggttgtacacgcccgcacggagggtaaagtgttttttaaccgtgtaataaccggacacgtccacaatataccaagggcgggtacggcgcgcggtggcttttgtattgcggctgttgccgttgagcaaagcccggctgcccaacaactctgtgatttccttggctttggaataagtcagcataccgttcacaccccatttgccttccggttggtcatagcccaagccgacgacatagcgcgagggttggatggcatcaaacagatgtgattgaatatcggtgcggtctgcgcgttttttgatgtcgcggacacggacacgattataggcaaatgtagaataccaaccttcgggcaatttatcccatacgccgttccaatcgattttgcccaaaatattgatgccggtaatccgcgcgctttgggcattgaggtaagccgggtcgcctttggcttcttctttgccgtctttaatttgcgcttcataaccccggacaatcaaatcgcggtaggcattgttgaaccaacttgcctccaagttgccgaaatcgcctttaaacacgatgccggcttctttgttgaacgatttttccggatcgattttgaccgccttgctttgaacacccgcccgccagccgtacatttccgcaaacgagggcaggcggaagccggttgaggtgcggtaagtcaaatccagccagtcggtaggtttgaggacgatgccggcgttccaggacaaggtgcggtgcgtgccggtggaaacgctgccgtcgtccgaatgcgtgctgcggtagtcgtagcgcaagcccgcgccgacatccgcccacctgcccaaacggacattgtcccgaactgccgcgtaatagcttttaccgttgatgctgcgcggcgtgcagtccgtataagtattgttgcccaagcggcagatttgccccgtaacgacatttcccctgcctatggtgacccaataggggctggtttcactgccgttggggctgatttttttgccgttgttttgagggggcgtgttcgacgaataggcgcggttggcatgttgataataataatcctgatggcggagattagagccaaagcggtcaaacccgagattcacgctcaggttgtggcggattttggcggtatcgaaggattttttgaatgccgcctgcaagagcctgtggctttccccgtaaatcacgcgatcggatttgtaataggaaaacggcttgtcggcactcgggcggcaatatttgtccgaaccgtcggcagaacagtgcgtctgctgaaaatgattatccaaaccgatgccctgccggtcgtaagagaggcgggcataatccgcccaagtgtctttatcggcattggtatagacatattccaaaccgtagcggcttttggtgtgcgtctcgtcgtaaaacacgcccgtaccgtattccgcgcccaccagcgcaccgttttcgccgttggtaaacagtccgccgtatttgtggttgcccgcgtatttgccgttaccgggcaaagaacccgcctgttttttatttgcatcaaaaaccgccttggtcaggaatgccggaaccgtcatatcgcgcgtgtcgaaagtttgttgcgtgtgttcgagtatgccgccgatgtagtgccgcttattctcaaaacgaaaacccgggcggaacagccacgaccggctttcgtatgaaagcggatcggcgaggaagcggttgggacccgtgtagtctcgggtggaaaccgtttgacgttcgtctttgccgacaacatcttttttcggattcgctttacacgtttcataactcccgtttttgcattcttctttaacgatgaaataggcgtaattgctgctgtcttcaaccggcaccagcctgttaaagctctgaacgccgcgtcctgcatcttcgtgggcgcggatttcccccgcgcgccgcccggtgtggatcagcaaagcctccgcaccgccgatgcgccccgccagcgcgatggattgggtaagcccccggtttttgccggaataggcggttttactctgaatgccccactgcctgccttccccgataacatcgtcggcggttttggtttgaaatgcgaccgagcccgccaatgcgccgctgccttgttcgaccgagtttgagcctttgctgatttcgacagctttgacgttttcatactcgatttcattgattgcgccgctgctgcccgccgtcctcgtcccgcccaatgccgcctgcgcggtgtaggactgtatttgcgaaacgccgtccaccgttaaggaaacgcggtttttatccatgccgcgtattgaatagccggaacttgcgccccgaccctgttcgaccacggcaatacccggatcataacgggtcaggtctcggatattcaaaacctgttctttacttagcgtatcggaagacttgaccaacttgcccagcccggttacttcgttatcgcggcgggttttctgttttttggcttttacctgtatggtatccaactgtttttcctgtgcttgtccggcttgcacattttctgcataagcgggcagcgcagtcattaaagacaggcataaaatattgaatcggaacaaatgttgctgttgcatagtgtttccctaatcttcgctttcagacggcatcggaaggagcggtgccgtctgaggccttattcttgattgttcggcagccgtgcttatcgcacaggctgttggcgtttcgcaccgaatacgacagttgcactgctattgccggatgcatttgttgcatttttcgtttgtttatcgcccggataggcaaaccatccgcccaactcttcggctttgggcccgtaaaaaccgccctgcaccttggcatctgtgatatatgccttaggcgtgcgggtggtattgctttgatcgagatcaaaacctgactcagcagttttcgccgtaccttcaaagccgttgtccttaatattaccatcaatggtaaaggttgcctcctgcctgttgtcagcggttaacgtaccagtaatttttttatcggcaaaattcacagtaaattccgccctgttgccactcgttgcattggaagcattgccgctccagcttgtgcttttgtcgttggcaatatatccgtaccaagacccccgataaacgatgttttgctcgcttggaatctctttttcatcggtgcgctcgccttggaggaacatactttgttcaacttgttccgttttagcatcagcttgactactgctttctcctgcctgcatcgcggacttgctgtttttgcgcgtcaacattccgtatttcagataattgaggttggaacagcagacttcgacttcataggtttttgttttgccattggtatcacctgccgtatttgaagcggtttgcgccccattcgtctgcgtacctgcttgggcgtcttttttatcactttccggcgtgtggtcaaatttgcgggtaaaggctgttccgccatttgtaccttgattggcttgattgttcccactttcggaagcctcgggcaagagcggaatcataatgccgtcgacaaccagttgggcggcgttgctgaagttgtcgagcttttggacttccttatcgcccaatttcagctcgaccgcatccaaaaccgtggtcagcttaccgttttcagacgacgtgcctgccgcaccgtttgatgctgccgcatctgtgccgcctgaagccgccgcagtattgccatttgcgggtttgtctttggttttcgcgctgccgacaacggcaactttttgatcgtcgctcaaaaagcggaaacccaattcctcaccctgcgggccgaaaaagccgccgctcaaagaagacgaatcggaaacaaagggatgttccttggtttcgctgttttgttggggtttgtcggttgccgttgccttgccgttgaagcggttgcctgttacttgagcctcaaggctgtagtattgcgtggtggtggcttggttgttatcggtattcgcattgttgcgtatcagtttgcccgtcaattttttattatggaaatccacttctaaatttgaggtaaaaccataaccctcttgaccatctgtcagcgtggatttgtttttgttggaatattcttcgccgtcatcgcccgaaaatccgctatacctgtcgccttgactttttgaaggttggataatttcacgaaatttttgacccttttttgtatcggtcgcaaaatgccacacacctttataggtaatttttccagaagcgggaagttgtcgggaaggttctttaccgtgatagaagatataaccgtcgtcgccgttttttgcacttttaggttccacctttaagttaaactctcgtttggcgtgtttgtaaaaccagccggaataaacatatttaaaattttcgtaatcttttgcctgatttttaggttggtttataccgttgccagtgttgccgttttgatggtttgatggtttgagatagggggaagaataaatattgttgtcgctgtctgtttctactttttcgataaccgatttttgccgtttagggagttccttaggttcgtccggcaatcctgtcgcctcccaatcactctcgtccagtttaacctcgtcttcttttgcctgcggataccaattcctccgtttcaacctcattgcaaaaccgtatccgccttggtctttttgggcttgcggtttttcggaaaaaacatcttgatattttggcgcgggacgcggggcttcggtatcgacagaatcaagatcgaaactgccgcctccgcccaaacaagcactcaacaaaaacacaggcagcaccatagcagcctgattcaccaatggattgttcataataaatccaattcaattaaagaatgataaggattattattttatttatttttaacaaatttgcaaatacttttttatttttttagggaatacaccaaaatcccgtcattcccgcgcagtcatgaatccgaacgcgtccgcacggaaacctatatcccgtcattcccacgaacctacattccgtcattcccacgaaagtgggaatccaggacgcaaaatctcaagaaaccgttttacccgataagtttccgcaccgacagacctagattcccgcctgcgcgggaatgacgggattttaagttggggtcatttattggaaaaagcagaaaccgctccgccgtcattcccacgaacctacattccgtcattcccacgaaagtgggaatccagttcgttcggtttcgcttgttttaagtttcgggtaacttccacttcgtcattcccgcgcaggcgggaatccagtgtgttgagtttcagctatttagaataaattttgaaactctaatcgcgtcattcccacaaaagtgggaatccagtttttcgagtttcagtcatttccgataaattgccttagtattgaaggtctagattcccgcctgcgcgggaatgacgaatccatccatacggaaacctgcaccacgtcattcccacgaaagtgggaatccagttttttgagtttcagtcattcccgataaattgccttagcattgaatgtctagattcccgcctgcgcgggaatgacggcggagcggtttctgttcgcgtcattcccacgaaagtgggaatccaggacgaaaaatctcaagaaaccgttttatccgataagtttccgcaccgacagacctagattcccgcctgcgcgggaatgacggcggagcggtttctgttttttccggtaaatacccacaagctgaaatcccattattttcacaaaaacagaaaaccaaaaacagtaacctgaaattcgtcattcccacgaaagtgggaatccggttcgttcggtttcgcttgttttaagtttcgggtaacttccacttcgtcattcccgcgcaggcggaatccagtgcgttgagtttcagctatttagaataaattttgaaactctaatcgcgtcattcccacgaaagtgggaatccaagacgcaaaatctcaagaaaccgttttacccgataagtttccgcaccgacagacctagattcccgcctgcgcgggaatgacgaatccatccatacggaaacctgcaccacgtcattcccacgaacctgcatcccgtcattctcacgaaagtgggaatccagttcgttcggtttcgcttgttttaagtttcgggtaacttccacttcgtcattcccgcgcaggcgggaatccagttttttgagtttcagtcattcccgataaattgccttagcattgcatgtctagattcccgcctgcgcgggaatgacgaatccatccatacggaaacctgcactacgtcattcccacgaacctgcattccgtcattcccacgaacctgcattccgtcattcccacgaaagtgggaatccagttcgttcggtttcgcttgttttaagtttcgggtaacttccacttcgtcattcccgcgcaggcgggaatccagtgcgttgagtttcagctatttagaataaattttgaaactctaatcgcgtcattcccacgaaagtgggaatccagttttttgagtttcagtcattcccgataaattgccttagcattgaatgtctagattcccgcctgcgcgggaatgacgaatccatccatacggaaacctgcaccacgtcattcccacgaacctacattccgtcattcccacgaaagtgggaatccagttttttgagtttcagtcatttccgagaaattgccttagcattgaatgtctagattcccgcctgcgcgggaatgacgggatttgagatttctgtttttgattttctgttttcgtaggaatgacggtttaaaagttacccgaaacctcaaaaaaaaaggctgtgttttaatatagtgttgatagacgtacttggcttccatgtattcaatcgtggaaatctatatcttcgtcctcgccgaaatagtctatgcccgatatacaattttgatacacaaacttggaaatatgggtatcgtcgccggagcgatagaatgcggacagttatatatatacggtttttttagggaagcgggcagatgaagggcgggcggattttgaattaaccccatgcaaattgacttttgcgggcggttttacctcccatatacttacaaaagccaaatttttaaacatatatccttgatatatacacggcgtaaacatatactggaaacatctttaaattttccgaaattttaaatatgagcaactggaaacccaatattccctataacgatttaccacccctgccgccaaaacaggatattgaaagcaaaaccatcctgaaacgttgtatagccgcccgtgcatcccttgcccgtttaaagcaggcggcagaattgataccgaatcaagccatgctgattaacacccttcctgttatggaagcccgtgcaagttcggaaattgaaaacatcgtaaccaccacggacaagctgtttcaatccctgcaaatggatacggaacggcaagaccctgccacgaaagaagccctgcaataccgcaccgccctgtttgcaggctatgaatcactgacgagccgccctttatgcacacaaaccgccatcatggtctgcaacgccatcaagcacccctacgaaatggccatccgcaaaacaggcggcacagccctaaaaggaggcaacagcggaaatgttgtctataccccgcccgaaggagaagaaaccatacgcggcaagctggcaaattgggagcggtttattcacgaaagcggcgatttagacccgcttatcatcatggcggcggcacattaccaatttgaagccatccatccgtttacggacggcaacgggcggacggggcgcatattgaacagcctgctattgattgaaaaagggcttttggatttgcctattttgtatttgagccgctacatcatcgaaaacagggcggactattaccgcctgcttttaggcgtaaccgaacggcaggactgggaaagctggataatctacatcttagacggcgtagctgacaccgccgattggacggtatcgaaaatagatgcgatacgccgcctgttcgagcagacacggcaacacatacggacacacgcacaaggaatctacacgcacgaactggtaaatcttctgtttgagcagccatatacacgcattgccaacctagaagcggcagggatagccaaacggcagacggcctctaagtacctgaaagagctttcagacataggtgtgctgcaagaaatcgtcatcggcagggacaaactattcattcatccgcgcctaatggaactattgcggggagagggcaacagctttacttcattctaaccccctcttcccccccacatgactaacacgaaacagggattttgacacccgaaccgagaccccttgtatttcccccgcgaaaagccggcatccgcccgcgtatcatgggagcaacaaaacccctgcctaaaattttgacttgtgcaaattgggggtatatttgggggtatattgaaaaatggctaaaataaaatgtttaataaacaaaatgttgaaacttaatttcgatagagcatctgcatatcgtattgaggcgttcatggaatttgagaaagctatttttaaataagaaaaggtaactattaaatagctacctttctaaaattaaatatcaacacatcgttaaaacacagcctttatttttaacaaagttgcaaatgtttttttatttttttagggaatacaccaaaatcccgtcatttccgcgcagtcgtgaatccgaacgcgtccgcatggaaacctatatcccgtcattcccacgaaagtgggaatctagttttttgagtttcagtcattcccgataaattgccttagcattgaatgtctagatcccgtctgctcgggaatgacgaatccatccatacggaaacctgcatcccgtcattcccacgaacctacattccgtcattcccacgaaagtgggaatctagttttttgagtttcagtcattcccgataaattgccttagcattgaatgtctagattcccgcctgcgcgggaatgacggcggagcggtttctgttttttccggtaaatacccacaagctgaaatcccgttattttcacaaaaacagaaaaccaaaaacagaaacctgaaattcgtcattcccgcgcaggcgggaatccagtgcgttgagcttcagctatttagaataaattttgaaactctaatcccgtcattcccacgaaagtgggaatctagaacgtaaaatctaaagaaaccgttttatccgataagtttccgcaccgacaggtctagattcccactttcgtgggaatgacgggattttaggtttctgtaatctcgggcagctttccgtcatcgttttaacccaaagacaccatttcaatctgctccatcgtcctgcccagaaaacgctcgccgatggttctgaatttcaaaggaatatcgctgacgtaaaaacggtagtcgggattgttgttgtcggtattgagcaatccttcctgagcaaggacgcgtgcggtttcttcggccgttgtaattgcagaatcaaccaacgcgacattgcccgcctccctgccgattaagggcttgagcaagggaaagtgcgtgcagcccaacaccagcgtatcgatgccgtctgcaagcaatggtttgaggtattcgcatacggtcaggcgggtaacttcgtgttccagccagccctcttccaccaaagggacgagcagcggcgcggcctgcgtgcggacgagcgtgtcggggttgttcctatggatggcgcgcgcataagcattgctgttgactgtcgtattggtggcgataatgccgattttattgttgcgcgtcgttgccagcgcggctttcgcgccggcggaaatcacgtccaaaacgggcatattgccggttttttgacggattttctgccccgccaccgccgcaatcgtattgcacgcgataaccatcgccttgacatcgtgttccaataaaaaatcgacaatctgcatcgagaaattttcgatggtcgccttagatttcgtcccgtaaggcacgcgcgccgtgtcgccgaaataaatgatgttctccatcggcagccgttccatcagcgctcgcacattggtcaaaccgccgattcccgagtcaaaaacgccgatgggtcgctgcctgccgatattttccattctttttccaatccgtcctaaacatacaatccgcgtattgtacacgcgccgctttttcttgacagccgttgccgtctgaaagcagaacgcggatttggctgttataatgctcggacaagaagcatccgcccctcgggtgcaaagtttgcaaaacctgcaaaactgcccataataccctagaccttacaacaaaccgtttccatgtctgatttaccctctatctcccgattccttgccgacgaagccgccacactcgatttgggcgcggcgtggtcttcccgtttaaacgcaccgctggtcatttatctcgaaggggatttgggtgcgggcaaaaccacgctgacacgcggcatcctgcgcggattgggtcatcagggcgcagtcaaaagtccgacctacgccatcgtcgaatcttatccgctggaacgcttcaccctgcaccatttcgacctctaccgcttctcgttccccgaagaatgggaagacgcggggcttgacgaactgtttgccgcaaacagcgtctgcctgatcgaatggccgcaacagggcggggaatttacgccgcccgccgacatcaccgcaacattgacacacgacggcgacggcagaaaatgcctgctgaccgcccataccgaacgaggacgcgaaagcctgccgctatgatcaaactgacacgaagacaaatcatccgccgcaccgccggcacactgttcgccctaagccccatcgcatccgccgttgccaaaacggtacgcgccccgcaattcaccgccgcacggatatggccgtcgcacacctacacccgcctgacgctggaaagcaccgccgcgctcaaataccagcacttcacgctcgacaacccgggcaggctggtcgtcgacatacaaaacgcgaacatcaataccgtattgcacggactgtctcagaaagtcatggcagacgacccctttatccgcagcatacgcgcgggtcagaacacgccgaccaccgtccgcctcgtcatcgatttgaaacagcccacccacgcacaagtcttcgcgcttccgcccgtcggcggctttaagaaccgcctcgtcgtcgacctctatccgcacgggatggatgccgacgatccgatgatggcactgctcaacggtagcctgaataaaaccctgcgcggctctcccgaagccgacctcgcccaaaacaccacgccccaacccgggcgcggcagaaacgggcgcagacccgtcatcatgctcgatccgggacacggcggtgaagaccccggcgccatcagcccgggcggtctacaggaaaaacatgtcgtcctatccattgccagggaaaccaaaaatcagttggaagcattaggttacaatgtatttatgacgcgcaacgaagacgtgttcatcccattgggcgtgcgtgtcgccaaagggcgagcacggcgggcggacgtatttgtctccatccacgccgatgccttcaccagcccctccgcgcgcggcacgggggtttatatgttaaacaccaaaggcgcaaccagctctgccgccaaattcttggaacagacgcaaaacaatgccgacgcggtcggcggcgtaccgaccagcggcaaccgcaatgtcgataccgccctgctcgacatgacccaaaccgccacgctgcgcgacagccgcaaactcggcaaactggtgcttgaagaattgggcaggctcaaccatctgcacaaaggcagggtggacgaagccaatttcgccgttttgcgcgcacccgatatgccgtctatcctggtcgaaaccgccttcctgtccaatcctgccgaagagaagctgctgggcagcgaatccttccgccggcagtgcgcccaatccattgcctcgggtgtccaacgctacatcaatacatccgtattgaagcggggttgattccgaaaaataaatgccgtctgaacatttttcagacggcatttttgtacactttcctcaacggttcgatccttccaccatatcaatcaggaacaggcggcagtcgatgttgccgttataaagcgggattttccgcttgggcgacaggcacatgaatttgggcatttccctatcgccggtaaacattgccgccaaccagcctgcgtaatgttttttcaaccacgtccccaactgcggatacagtgcctgcaaggcgcggacttcctcaaggcgcacgccgtagggcggattggacaccataatgccgttttcgccgttcggtcggacggactgcgcgtcggcaacgctgaaggaaacgatgtcgtccaccccggcgcggcgtgcgttgtccaatgccgtctgaacgatgcggcggtcgttgtcgctgcctgcaatcggggcgcggacggggcgggtttgcgcttcggcgcggcgccgcaaatccgaccacagcgttttatcgaaattttgcagtttttcaaaaccgaaacggcgcatcatacccggcgcgcggcgggcggcaatccaagcggcttcgatagcaatcgtgccgctgccgcaaaacgggtcttgaaacggctgcgtgccgtcgtagcctgccgagagcagcagtccggcggcaaggttttcgcgcagcggggcttcgccggtatccaggcggtagccgcgtttgaacagggcttcgcccgaagtgtcaataaagatttcgacattgcgttcgttcaaaaaggcgtggatgcggacatcgggcgcggctttgtccacgctcggacgtgcgtcgtaaatgtcgcggaaagcgtcgcagacggcatctttgacggtcagtccgacaaattggatgctcttaacgttggcacgctttgcctcgactttgactttgaacgtctgctgtaaagtaaaccaattaaaccagttgatatttttggcgagtttgtagatgtcgcgctcattgcggtatgtccctttggtcaggcgcagcaggatacggctggcagtacgcgaatgcaggttggcggcgtaaacctgttccaatccgccccggcaggaaacgccgccgtcaaacacttgtacatcggtacagccgaggctttcgagttcttgagataaaacggtctccaagccgcgcgggcaggtggcgaaaagtgtatataaagtattcataacgtgtcctttccggacggatgttccggcaatggcggattgaaaggtttattcggcggtaaatgccgtctgaaatgtccgactgccgattgtaatgtccgccgtaaaatcgcgcctgccttcgacacagatgggcaggcggatgcgtactgcctgccaagtccccgacggttgccgctcgaacatatagcggttgaaacccatatccatatttttcatactgaagctgatgctgacctgttccgtgccggcgggcgcgtgttcgatataaatatcaaacggttttttggttgaaacggcggcggcgcggacgcggcttccgtccggcagcgtgcaaccctcggtcaaatcgcattgcgccgccacagcttgcggctgctgcgcctgccaccattgcaacaaaacgagcttgacggcggcaaaggcaatcagcagcagtgcggcaagcagtaatttacggtttttattcatgattcttccctattgtttcatcccttaccaccacgtgcgcccccaatccgagccatagttttccataacgtgcaaccgtctgtccgtttgctgcaagtacgagcggcacggatacgccctgccgcagggcttctgccgcctcttgtgcctgaacatcatcgcacacgcgccaaacgaccgcatccgcgcccttttcctgcgcccgccgccattgttcgcgggtctgcaccaccatccacacgctgtcggcgtgttcgggtctgtcctgccattgcgccgcctccatcaaaacgttcgcaccgcttccctctgccgaacccaaaggcaggacgcggtacgcgcccatactgttttctccgtgcaaacccgttttcaggctgccgtacaaacggcgcgggacggacagcgaacgcaaaagcgcgccgttggcgggcagcatgggggcaacggtaaaatcacccgccttctgccaagaccattcctgcccttcgcgggattgcggtttgcccgtccattggtcggggttgacccataggaatttcaggcagacgcgggcgtgttcgtaggaatggattttggtcaaccaaggcgtggcggcgaggatgcggatgccgagttcttcttcaaactcgcgttgcagggcttggaagtcggtttcgcccgcttcgaccttgccgccggcaaattcccaatatccggcatagggtttgccttcggggcgcgagctgagcaggtagttgccgtctgaatcgagcaaggatgccggcaacgacgcggataaggggtcgggtgtcttgaatcatggcgggtacgcggttggtcggtcggagtgcaaatgagggacgggcaatgccgtcaacgggtttgccgcatttcagacggcattatttttcggcaacgacaaacgccaatacggtgtcttcttcgtcgctcatgctgaggctgacgcggctgatgccttgttcctccagccatttggacagggcggggccgtagaaaaattcgggcttgcccaatgcgtcatgcccgatgccgatgttgcggaaggaaaccgcgccgcgtatgcccgtgccgacggctttggcaaaggcttctttggcggcaaagcgtttggcgaggtagttgacgggtttgcccgcttgcggaaattcaagcagctcttccggagtgaggatgcgcccggcaaacgcctgtccgaattttttgtttaagcggatgatgcgcttgagggaaacaatgtctgtgccgatgccgtaaatcatatttgcgctccttcgcccttggttgcgggtagtgatgaatgtgatgatgaatgccgtcaatttcttggggcgttaaaatggcgtgaatatccacttttggggttttgtcggtaacaattttcactgtaaccttttgcatttgaaattctaaaacatcgtgccaattatttaataaggagttaaggcatttaataatgaattaaagtttgattaaacccgaatgcccgattttcagagccaataccaataaaacaataaaaattaacattttaaaaaaatttgggctaatcttagtccttaaccgaattccaacatacaatccaataacagacaatacggacagtaaaaatattaaaccgtattcactcttatttaataaccaatactggtctcttagcatatatatttgaacaattttcgccaaaagatagcatagattgcttgattttacgatacgatttttattttctgtttcgctaagcaaaaatattaacaatatgggagacatggcattggttgaaccgccgatgatgcctgccaaaaacccaaaaagaaccatattcttattattggcaactacttgaatattttttgcttttgcacatacatttaaaataccattgacagaataatacaatgtaatgattgccatcagtaaaagcagccaagacactggaagtatcaaaagcaacttcacccccaaaatgctgccaacgacgctgccgatagcaagcaatttataggtttttaaataataaacaatctcttgccaaaaaccctttttgttattgctgcatagaaccaacaagctcattaacaggcttggtaatgccaccaaggcaacaaccttagacaatggcatgataaaagccaatgcggttgtaccgagcatcggaaatcccatgcctgtaattccgtgcagtattgcggcagcaacaaaaacgatagattgcattatttcttgcataaccgtcctttatacagtaattcttgctctaatataatgcctgtttttatccgtataatcagttctggcatgcaagccattgacattgtcaataataatcaaaccatcatcttgtgcagaaaattcttgaatatcactcgcattttttataacatttataagataatcaagtgcaagtaccatttcctttgatactttatttctattttcttcaatacctttatagatacaatcacttctaaatctaatcatttgagtattgaccgataagatattaccccatctcacaccttgttttttatcaaatgatgctggtgttttaaatggatataaattgcccgttaatgtttttaagtgttttttaccggtttctgttttagataactgattgacaatatctgatgaacttaaaaatagggaattacctccatcattggctgattttactacatacataaccaaataactttccgggttttcactaaaagatgaatcactatgaagtggacattctccaacatcttccgagaaagttatatcattatttatagtggattaacaaaaaccagtacggcgttgcctcgccttagctcaaagagaacgattctctaaggtgctgaagcaccaagtgaatcggttccgtactatctgtactgtctgcagcttcgtcgccttgtcctgatttttgttaatccactatattacataatcatcgcctcaatatttaatatcccaaaatatagatttaaaaccatcgcctttgtggtttgtcagcattcctaattgagatagaaagtcaaataatttcttgtttctccggctgccatcaagatggtttagattaagacctcgaacaatacaatacccaatactctgtactgtattgtgaatttcttctatcaaactattattgtttgcagataaaatatacttttgattcatatagtgaattaaatttaaaccagtacggcgttggcttgccttgccgtactatttgtactgtctgcggcttcgccgccttgtcctgatttaaatttaatccactataacatatccctgtcgtgaaatgctgtctgaaagggtttgcctgcccttacggcagcagccttgccctgaacatcgcctccttcatttggcgcacggcttcgggcagtccgaggaagagggcttgggcaatcagcgaatgcccgatgttcagttcgcggatggcgaggatttgggcgatgggggtaacgttgtgtatggtcagtccgtgtccggcgttgacgaccaagcccaaatcgccggcgaaatgcgcgccgttttggatgcgctcgaactgcctgatttgttcggcgtggctgcgcgcgtcggcatacgcgcctgtgtgcagctcgacaacgggcgcgccgacatcacgggcggcttggatttgcctgtcgtcggcatcgataaacaaagacacgcgtatgcctgcgtcggtcaggattttggtgaacccggcgattttttcctgttgcgccaatacgtccaaaccgccttcggtcgtgatttcctgacgtttttcaggcacgatgcacacgtcttccggcatcactttcaaagcgttttccaacatttcttccgtcaacgccatttcaaggttcaggcgcgtgcggatggcgtttttgacggcaaacacgtccgcgtctttgatgtggcggcggtcttcgcgcaggtgcatggtaatcaaatccgcaccgtgcgtttcggcaaccagtgccgcctccacggggctgggataagtcgtaccgcgcgcattgcggacggtggcgatgtggtcgatgttgacacctaaaagcataatctttccttttatttctgccttcagacggcatttgaagccgtgccgtccgaagtcgggacggtttcccgggcggtttctttgcggtcaaactgccgtatctgttccaacacctgccgcgatttcagcccctcgggcaacaggtggcggataaaaagccgtgtgattttcaatgcctgttgcaggctttcggcagtgcggaaactgccttcgcgcaaatcgatcaggctctgcccgggggcgacaacgccggcggcgtgcggcggtacggcaaatccttttccgacggggaagacggctgtttccgggcggacaaggtatgtgccgcctgccgcaatcgtcccgccgtccccgtcgcggttcaaatcgggggcaacgcccaacaggttcagcagccgccactcgaaacggcgcaagtcgtcgatataagcggctttgcagcacaccgcctccatcacttccgccaacgcgtcgtataactcgggcaccgggtcttcgcgggcggtcagtttcaacaccaactcgttcacatacaatccgccgaacaacgccctgccctgaggctgccgccaaccgccgacccattcggcgcggtgtagggttttgagttcctgactgccgtaccacgacacgctgacgggcacgaacggcaccaatacgccgcgcagctcgctctgccttttgcgcgcgctgcgcgccagcaaagccacacgcccgtaacggcggctgaatgcttcaacccacaggctgctttcgcgccagggcgaagatgccagcataaaaacgggttcatggttgactcggtattcggacataatcgttggggaaatgccgtctgaacgctgccgccgctacaaaacggcggtcgggtacgaaccgatgactttgacgaacgaagcgcgttcgcccaagcgttccaatgccgtctgaatctgcgcgtcccggcggtgtccttcgatgtcgatgaagaacaggtattcccacaaaacggatttgctcggacggctctcaaacttggtcatggaaatacccgattcggtcagcggttgcagcagcgaggcaaccgcgcctgcccggttgggcgcggaaacggccagcgaagtcttgtcgctgccgcttgcaccggtttcgtgatgtcccatcaccaagaagcgcgtggtgttgttcggttcgtcttcgatgcactcggcaaccatatcgagtccgtagatttccgccgccgtgcgtccggcgatggcggcaaccgtaccgtcgtccgattcggcaaccagccttgcggcttcggcattgctggacacggcaatccgttcggcgttgggcaggtgtctgcccaaccagtcgttgcactgcgccaacgcctgcgcgtgggaaaagactttggcaatgccttcggtgctgccgttgtttttacgcaaaaggttgtggtggatgcgcaaaacgatttcgccgcacgcctgcaacgcggtaacggcaagcaggtctaacgtgcgaccgaccgagccttcggtcgaattttccacgggggcgaccagataatccgcctgacgcgtttcaacctgcttgaagcagtcgtctatggtcggacacgccatggtgtgcgcggcgtgtccgaaatgtttgattgccgcctgctgggtaaacgtgccctgcggccccagataggcgatggtcagcgggcgttcgacggcgaggcactcgctcatcacttcccgaaacaggcgtgctaccgattcgtcgggcagcgggcctttgttcaaatcctgaatgcggcgcaacacggcgacttcgcgttcggggcggtacactgcgcccgtgcctttcagctcgccgatggcgtgggcgtgttgcgcacgttcgttgagcaggcgcaggatttcggcatcgatggtgtcgatggcgttgcggtggggaaggaggagttcgtcgatagtttgggacataatttcgcctgaacagtaatttatcgtgcattctaacatcaaatgccgtctgaaacggtttcagacggcattttccgttaaaggtattcgctttgcccgttttctttccacgcacgatgcgagcagagccacagaagcgcaatgccgcaagaggtggacgcggtcatcgttgccgccatcacggttgccgaaccgtcgtgcaagaaggtcgccgccatacccacccccgcgccgattaaagattggaatacacccaatacggcgtttgcgctgccgccctcttctttgaaataggacataaaacacgcctgcgtgtttgcaccgaccaagccctgcgtaccgacggaaaacatcacgcacgcgaccagcagccaaaacgggggcaacccgaaaaacagcacggcggcgagttgggacaggttggcggcaaactggacgacaatcccccacagcaggatgctttgcggatgcacgccggttttgagccgccacgcggtaacgcggttgaaaaacatcatcgtgatgatgttgagtgcaaacgcccaagcgtattgatgaggcgtaacacggtagagctgctggtacacgaaggaagattcggtcagaaaggcgaacatcgaaccgaagctgaatgcctgaaaaaacagataacccatcgcagcacgggttttcaatacgcgcttgaaccgccccgccaccagcccgaacacgtcccgtccgattttgccgccgacggcgggcttgggcaggaaatactgtaccaaaccgagcagcaccagcgaatacgccgccagaaaaacaaaaatcgcctgccagccacccaagccctgcaacaatgcgccgaccatgggtgcgaccagcggcacaaccatcaaaatgatgccgataagggcaaacatctgggcggctttgcgtccggaataataatcgcgcaccattgcgccgacgatgaccacagtcatgcccgcaccgaatgcctgcacgacgcgcaggttgaggagctgttcggcactcgaaacaaatacgatggcggcaacggcaaggcaatatacaatcaaaccggtcagggcgacgggtttgcgccctttgatgtcggacaccgaaccgccgaccacctgtccgaacgccgtgccgaacataaacaaactcaaactctgttcgatgcggtgaacatccgcgttcagcgattgcgccatttcgggaatcgcgggcaggtaggcatcgatggaaaacggcatcagcgtaaccagcatcgccatcaaaaccgccatcagtttttcgctcatttcaggataatgggcagaaggcataaattctcgtccgattcgcaaacaaaccgcccggcggcggaaaacacaatacgcggaaacggaaaattttaacacaccggcacaaacaggcggcaacaaaagccccggcaaaaccggacgaaccggaacgatatagtggattaacaaaaaccagtacagcgttgccttgccttagctcaaagagaacgattctctaaggtgctgaagcaccaagtgaatcggttccgtactatctgtactgtctgcggctcgccgccttgtcctgatttttgttaatccactataaaatcccgtcattcccgcgcaggcggaaatccggacatccaacgctgcagcaatttgtcggaaataaccgaaactcaaaaaaccggatgcccgcctgcgcgggaatgacgacgcaaagatggtcgttatttcggataaatatccgtcttttcgttccggatacccgctttcgcaggaatggagatggaaagatttcagcctattcggcaatcatcaaataccgcttcccaactttatttttgatgcgacagccggccggcaaccaaggtggcggcgatgacgacaaacacgcccaaggcggacacgggcgacaggtgttcgcccaaaatcaaaaccgccagcagcacgccgacgacgggttcgagcgaaatcaacagtcccgaaacattggcaggaacacggctcatccccttgttccacagccaataggcgtaccagccgcaccccaaacccaaatacagcagcgacaataccatcccgacgctccagtccacggtataactttgcgccaaagcaagcgaaaacggcaggcacatcaacgatgcggcggcaatggaaacagatgtgaatgccggtgcgccgatgcgtgcaatcagcctttgcgtcggacgcatagcggcacaaaagcccgcgcccgccaacaacaccagcaggcagccgaaccagccgacttcgccgccctcttccgcaccgcccgccatcagcagcgcgacaccggcaaatgccgccgcgccgcatatccagtggtaggcacgcgctttgtcgttgaagaaaaagtgtccgacaaacaccatcagcagcggctcgagtccgacaatgaccgatgcgctggcggcggaagtgtatttcaacccgacaaactgaagcagcagggtcagcacatagttgacgaacgacacaatcagcaacggcttccattcctcacgcggaatcttgccgacatgacggcggcaggcgggcagtgcaggcagcgcggcaattagcaggcgcacgccgaccatcaatgcgggatcgatgccgccatagacatatttggcggcaataaacgagctgctccagataatcagggcaaggatttggtaaaacatagtgagtgataaagtcagatggtcatacaaaagtatagcggatgaacaaaaatcaggacaaggcgacgaagccgcagacagtacaaatagtacagaaccgattcacttggtgcttcagcaccttagagaatcgttctctttgagctaaggcgaggcaacgccgtactggtttttgttcatccactataacagcaaccctgtcgccgtcattcccgcaaaagcgggaatccagtccgttcagtttcggtcatttccgataaatgcctgctgcttttcatttctagattcccactttcgtgggaatgacggcggaagggttttggttttttccgataaattcttgaggcattgaaattccaaattcccgcctgcgcgggaatgacgaatccatccgcacggaaacctgcaccacgtcattcctacgaacctacatcccgtcattcccacaaggacagaaaaccaaaatcagaaacctaaaatcccgtcattcccacgaaagtgggaatctagaatctcagactttcagataatcttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaaggacgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcgcaggtaggcgcatacttgttcgggactgagtttgcggcggataagggggtcgatgtgctgaatcagctgcgaatcgagcttatagggttgtcgcttacgctgtttgatagtctggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccaatctttgaatattgctgttgttctaaggtctagattcccgcctgcgcgggaatgacgaatccatccgcacggaaacctgcaccacgtcattcctacgaacctacatcccgtcattcccacaaggacagaaaaccaaaatcagaaacctaaaatcccgtcattcccgcgcaggcgggaatctaggtctgtcagtgcaggaacttatcggataaaacggtttcttgagattttacatcctggattcccactttcgtgggaatctagaatctcagactttcagataatctttgaatattgctgttgttctaaggtctagattcccgcctgcgcgggaatgacggctgcagatgcccgacggtctttatagcggattaacaaaaatcaggacaaggcgacgaagccgcagacagtacaaatagtacggaaccgattcactcggtgcttcagcaccttagagaatcgttctctttgagctaaggcgaggcaacgctgtactggtttttgttaatccactatagtacggaaccgattcacttggtgcttgggcaccttagagcatcgttctcttttttgttcatccgctatattgtgttgaaacatcgccccaaacccgatacaatccacccctgcaacatcagtgaaaatctttctttttaatcagttaaaaccgaatacggagtcgaaaatgaatccagcccccaaaaaaccttctcttctcttctcttctcttctcttctcttctcttctcttctcttctcttccgcagcgcaggcggcaagtgaagacggcagccgcagcccgtattatgtgcaggcggatttagcttatgccgccgaacgcattacccacgattatccgcaagcaaccggtgcaaacaacacaagcacggtaagcgattatttcagaaacatccgtgcgcattccatccacccccgggtgtcggtcggctatgatttcggcggctggagaatagcggcagattatgccagttacagaaaatggaaagaaagtaattcttctactaaaaaagttactgaagagataaacaacaactacaaagaaacccaaacaaaacatcagggaaacggcagcttccacgccgtttcttctctcggcttgtccgccatttacgatttcaaactcaacgataaattcaaaccctatatcggcgcgcgcgtcgcctacggacacgttaaacatcaagttcattcggtggaaacaaaaaccacgactattacctctaaaccaaagaacggctctccacagggaggccctattatacaaactgatcccagcaaacctccctatcacgaaagccacagcatcagcagcgtgggtcttggtgtcatcgccggtgtcggtttcgacatcacgcccaagctgaccttggacaccggataccgttaccacaactggggacgcttggaaaacacccgcttcaaaacccacgaagtctcattgggcatgcgctaccgcttctgattccccggcaccgatgccgtctgaaccttcagacggcatccaaaacccggtatttcaaggcgggcaggcggttgcggacgctgttcaggcggttggcatcgatgtctgccgtaacaacgccttcgccctcgggcaatacgtccaacacgtcgccccacggatcgacaatcatgctgtgtccgaacgtgcgccgtccgttttcgtgcaaaccgccctgtgccgccgccacgacgtaacattggttttcgacggcacgcgcgcgcagcagcagctcccaatgcgccttgcccgtcgtgtgcgtaaacgcagcgggcagcatcaatacgtcaaacggcaactggcgtcggaaaaattcgggaaagcggacatcgtaacaaatgcccgccgccaccggcacgccttctgccgacaagtgcggcacatccccgcccgcgcggatggtatcggcttcggcatagcgttcgcccaaaccggaaaaaccgaagaggtgcattttgtggtacagccccgtccttacgccgtcccgtccgtacaccaacagcgtattcatcactttacccgcctcgcagctttgcagcggcacagtcccgccgaacagcaccacgccgcattctttcgccgtttcgctcaatgccgtctgaaagcgtccgccgcccaaaggctcggcaagcgcgagtttgtcggtatcgtttgcgcccatcagcacccaatattcgggcagcagcacccaatccgcaccctgctccgccgcccgtgcgaccaggcgtttcatggcggcgacgttggtttccggcgacacgcccgacaccatctgcacggcggcaactctgattttgtccatttcttctcctttttcctgccgaccttgcggcatattccgccgataggctaccatgacggtactttgcgaaaaccgtttacacaaatgcccattttgaaccatattgccctcatcggtgtagggctgatcggcggttcgttcgttctcgacctcaaaaggcagggactcgtccgcaccgttaccggtatcgacaccgaccgcgacaacctcgaacgtgcattggaacgcggcgtgattgaccaggcttccgttgccatcgacgcggacagcatcggcggtgcggacttggtactgattgccacgcccgtcgccaccgttcccgccattttgaccgcgctgcgccccgttttgccggaacacacttggatttccgatgtcggcagcaccaaatcttcggtcatcgaagccttccgccgctgtctgcccgaccgcctgcaccactgcatcgccgcccacccaattgccggttcggacagaagcggtgcgcaagccgcgcagttcgggctgttccgccacagaaaactcatcatcacgccacacggcggcgaacattcagacggcattgccttggtagaaaacctgtggcacgcggtcggtgcggaaatttatacgatggacgcgcaacgccacgacgcggttttcgccgccgtctcccatatgccccacctgaccgccttcgcctatgtccaccagattctcgaccaccccgacggacaggaatatctgaaattcgccgccacgggctttcgggacttcacccgcatcgcctccggtcatcccgccgtgtgggcggacatctgccttgccaacaaagacagcctgctgcaactggttcaaggcttgggcaaacagttggacgttttggcaaacatcctgaccaccgacgaccgcgaagccctgtaccgctattttgaagaagccaaaaccacacgcgaccgctggctggacggcaactgaccgccctgccgtctgaaaagcaaaccgcccagacccgaaatctgcggcggtttgtctcaaccgggcctgccgtccgaacgcggacgaatcagccaaggaatatacttccacgcatacaccaaaagcgcgagtgcaaacaaaaccgaagaggtgcggatgctgtgcgtgtaggcagtgccggaagaaaatacggcaaccatacggacggcggttgccgccatcatcagccaaaacgcaacgggaacggctttgggcggcggataaatcggattgcccgtatgaccaagcgcggtacgcgccatcatgcccaaagtcagcacgccgataccgccgaccccgatcagatgcacacccagattgaggaaagcgggtttgaaataagacgcgccgaccgcaatcagccccaatccggtaaacagatagccggcaaacagaatccacagcatcggctctttcaacacgggtttataccaccagcggtacacctgcacggtaaaaatcacacctgccgcaaaggcaaaaacggcagacagccaagccaacacaccgtgcgccatcagcatggcagtcagcatgggcagccacagcgaagcctgcgccacccatttcggactgggaatctgcggcacattcaagcgtttggacgtaaaaaacgaaataatccgcgtaccaatcagaccgataaaacccgacaccatcaccaagcccgactgcaatccgctcaagagtccgcctaggttgccgttgtgcagctggacgtggaacgccgcatgcgtgccgcccaagacgaacagcgcgaacacggcaacatagttgcgttgattctgcgaacggataacgggcaaagccatgcacaccgcgccgtaccagaaaaacagcgtaccgagtatgccgcttgccgacgcaccccaacccgggataaaggcggcaatccgcgcagccagccaaaagatagtcaagccgaccagaacgccgccccgcgtgggcggctgccccgtccaagtggcgacggcggtcagcaggaaggcgatgacgaccagtccggcataaccccaaatcatctcatgcgcgtgccaatagaaaccggacagctcgtgcgttcccgtgtagccgaaaccccacagcaatacggacaatgcgccgtacagagccgccagcgaataaaatgggcggaacgccattgcccagacggggtgcttggtaaatttcatgtgtgttccttgtttatcattaatatatttaccgcaaaacggaatcatgccggcaaaaacggttcggcggcgggaaacagctcgcgttcttcaaagcgcgcgtggtcgcgcagggttgtggcaaaagcggtattccacgccgcgttaccgtattcggggcttgccatcatctgccgcagtcgggcgtggtctttctcgaaacgttgtttcaattcgggggcgacattctgccaaattggggcaaacttggtttcttcttcgcgaaaatgggtttccaattcggaaaaatgcggttcgagttcgtcccgatgcctttcttccggcgtccgcaacagacgcacgcacagggaaagcgaatggtggtggtcacgcgaaagcccgataagggcgggatgtcgtttcaacggtttcatgattttgagttacaataacaaattctcaaacggtagcgcggatgtttcagacggcataccgccgcagacaggctgcattctaccgccccgacggacagggtttcaaccattaaggtattgtccgtgaaccttaaaccgtaccgataagaataacaatccataccgagaaaatcatgtatttgacacaacatacggactacgggctgcgcgtccttatctacactgccatcaacgacgatgcgctggtcaacatcagtaccatcgccgtaacctacggcatttccaaaagccatctgatgaaggtcgttaccgcgctggtcaaaggcggcttcctccacagtgtgcgcggaaaaggcggcggtctgcggcttgccgcaccgcccgaccgcatcaacatcggctcggttgtccgccacctcgaaccgatgcagctggtcgagtgcatgggcgagaacaacgaatgcctgattacaccgtcctgccggctgacgggcatactcggcggcgcgatgaagtcgtttttcacgtatctggacggtttcacgctccaagacctgctcaacaagccgacctacgacctgctctacgaaccgagaattccgattgcggtgcagtaatgcatcaaaatgccgtttcaaacggatattccgaccgagcgcgatacgcgccggcatttcggactgccgccggcaaggcgcgcaatgccgtctgaacagccgatgcttcagacggcatcggtttccctacaaaccgaacaccgccgtatcgccgcaaccttggcgcaccaattccgtgccgtcggtcatatcgacgacggtggtcggctcggttccgcaccagccgccgtcaatcaccaaatcgacggcgtgttccaaacgctcgcggatttcataaggatcggtcaatggttcgccgtcttcgggcagcatcagggtgcagcttaaaagcggctcgcccaattcccccagcagggcttgtgcaatggcattatcgggaatacgcagcccgatggttttgcgtttcgggtgcagcgtgcgcgccggcacatccttcgtcgcctgtaaaataaaagtataaggcccgggtgtggcggctttaagctgacgaaactgtacgttgtcgactttggcgtatgtgcccaactcgctcaaatctgcgcacatcagggtcaggtggtgtttcaaatcgattttgcggatggagagtatgcgttccatcgccgccttatcgccgagtttgcagcccaaggcataacaggaatcggtcggataaacgaccacgccgcctttattgacgatttcaaccgcctgcttgatgaggcgttcttggggattgtcgggatgaatagcgaaaaactgtgccatggtttgtttccttatcgtcatgttttccgtattgtacgcccgaaattcaaaatcccgtcatttccacaaaaacagaaaatcccgtcattcccgcgcaggcgggaatccggttcgttcggtttcggtcatttccaacaaatccctgtcgctttgcgttgctggtttcctgctttcgtagaaatggcggcggagggtttctgttttccgacaaatatttatgtttacaggatgaaattccaccgtccgcacaaaaatgcaagataacaaaaaaatgaacaatgccgtctaaaatcctcatcagcctaatcgggcgtttggggtttcagacggcatttttgcggactcgtcccttttttggctacaagatgccggcaagttcggcagtgtcgcaggcaatcatcagttcttcattggtcgggacaaccaaaacagccggagaagaatcggtcgggctgataatgcccgaattgccgtagcgtttttccatattggctttggtgtcgatgtgcagacccaagaaatcaagataggaaacggttttggcacggatattacgcgagttttcgccgataccgccggtgaacacgagtgcgtcaacgccgccgcagcccacagccatcgaagcgatgtatttggcgaggcggtaggtcatgacttcgagggcgaggcgcgcgccttcgtggccttcgtcggcggcgatttcgagggtgcggcagtcgttggaaagttcggaaataccgagcaaacctgattttttgttcagcatttcatccacttgggcaacatccatcccggcgtgggaagtcagatagctgtatacgcccggatcgatgtcgccgcaacgtgtacccattaccaaaccttcgatcggcgtgaaacccatactggtatcgacggatttgccgtttttgatggcggtaatggatgcgccgttgcctaagtgggcaataatcatgcggatgtcttccagaggtttgcccaagatgcgtgcggcttcaggggcaacgtaacgcatactggtgccgtggaaaccgtagcggcggaaagcgtattttttacgcaactcgcgcggcacggcataagtgtaggcacgctccggcatggtttggtggaacgaagtatccatcacgccgacattgggcagaccggggaaatgttcctgtgcggcaaggatgccgctgatgttggcggggttgtgcagcggcgcaagcggaatgcaggcattgagttcgtccattacggcctggtcgatcaaaacagactcgctgtatttttcgccgccgtgggcgatgcggtggccgatggctttgatgcggtcgtgcagaccgtgtttttccagttcgttcaaaagcatacccaccgcgccggcgtggcaatttcggccgctcaggggaacttggcgtttgttgccgtctttgttgaacgtaatgacggcttcgggcgtggtcaggcgttcgccgaggcagcttaggacgacgctgccgctttttcggtcgataacggcgcctttgagcgatgaactgccgcagttcagaacgaggatgagttggtcggacatgatgtttctccttgtagtttgtggttgtttttttrgtgtggggtcgtctgaaaaaggcagacatcaggcgcaaggtgtttcagacggcctctttgggcaaagcgtatgccgcattttctatcgttattccgtccccgcctacgcgaggacaggctgtggcgggaatccagaatgtagaactcacgaaacctgttttcccctgccaatcctccatattgacaggtctggattcccgcctgcgcgggaatgacggtaatacgggaagctgtcttttatcggggtttccgtgttcttccttgtgatttgccgccttccgccacagggcaagggaaaggaatggtcagtgatttgatgtttacttgtttttcagacgacctttttatggctcgcgggcaaacccatgctacgtcaatttaaaaacaatcctcaggcaccctgacccaaccttccatcatcacgcgtgcgctacggctcatgaccgctttggtggccgtccattgtccgtcctgacattcggcggctgcaccgacgcgcaatgtgccggaaggatgcccgaagcgcacttctttacgcgttccgccgcctgcggcaaggttgaccagcgtaccgggtacggcggcggcggtcgcaatggcaacagaggcggtacccatcatcgcgtggtgcagtttgcccatgctcagggcgcgtaccagcaaatcgatgtcggcggcgttcacggttttgccactggaggcggtgtaatcggcggcgggcgcgacgaaggcgactttcggcgtgtgcgcgcgagcggcagcttcggatacgtcgctgatcagacccattttcagcgcaccgtaagcgcggattttctcgaatttttccaaagccgcggcatcgttgttgatgtcgtcttgcaactctttgcctgtgtagcccaagtcggcggcattcaagaaaacggtcggaatgcccgcgttgatgagcgtggctttcaaacggcctatattcggcacatcaatttcatcgaccaaattgccggttgggaacatactgccttcgccgtcggctggatcaagaaattcgatttgtacttcggctgccgggaacgttacgccgtcgagctcaaaatcgcctgtttccaaaactgcgccgttttgcatcggtacatgggcaataatggttttgccgatgtttttctgccagattttgaccgtgcagatgccgtctgaaggaatcttgcctttatcgaccaagccctgttcgatggagaatgcgcccacggcagcggtgaggttgccgcagttgccgctccaatcgacaaaaggtttgtcgatggaaacttgcccgaaaaggtaatcgacatcgtgatcggcgcgttcggacttgtccaaaatcaccgccttgctggtggacgagctggcgttgcccaaaccgtctatctgcttgccgtagggatccgggctgccgagtacgcgcaagaggattttgtcgcgtgcgcttcccgcttcccgcgccgcctcgggcaggtcggaacgtttgaaaaacacgccttttgatgtaccgccacggtagtaaacggcgggaattttaatttgcggcatttctagattctccttatgtagcgtgggctctgcccacgatttttatagtggattaggctgccactccgaccaaagccgtttgattccgcaaactgtcggggttcgccccaatctacggctactgtgttgtgatacggcagattattaaaccccgtcattcccgcgcaggcgggaatccagatttatccgcacagaaactcatcggataaaaaggtttcctcaattccactttctggattcccgcctgcgcgggaatgacgatttacagtatagtggattaaatttatagtggattaacaaaaaccagtacagcgttgcctcgccttagctcaaagagaacgattctctaaggtgctcaagcaccaagtgaatcggttccgtactatctgtactgtctgcggcttcgccgccttgtcccgatttttgttaatcctctataccatgtcaattcagcctttatttcgcgggcaaagcccacgctacacccactttccagaagtacattaggctgccactccgacaaagccgtttgattccgcaaactgtcggggttcgccacaatctacggctactgtgttgtgatacggcagattattaaaccccgtcattcccgcgcaggcgggaatccaaatttgtccgcacagaaactcatcggataaataaggtttcctcaattccactttctggattcccgcctgcgcgggaatgacgatttacagtagatgcctgccatatcgagaattacgtgaatgagcaaaatgttgaacccgacccacgctacgtcttgcttttcagacgacctctaagccgcgttcccttccaaaaaatcctgtgcaaaccgttgcaacacgccgccggcttcatataccaatacttcttctgcagtatcgaggcagcaggtaacgggaacttcaacggtttcgccgtttttacggtgaatcacgagggtcaggtcgcagcgcggtgtgcgttcgccgaccacgtcgtaggtttccgtaccgtccagttgcagggtatggcggttggtgtcgggtttgaactgcagcggcaacacgcccatgccgataaggttggtgcggtggatacgctcgaagccttcggcaacaatcgcttctacgccggcgaggcgtacgccttttgcagcccagtcgcggcttgagccttgaccatagtccgcaccggcaatgatgatgagcggctgtttgcggttcatataggtttcgatggcttcccacatgcgcatggtttcgccttcgggttcgacgcgggcgaacgagccttggcgcacgctgccgtcttcgtttttcaccatttcgttaaacagtttcggattggcgaaggtagcgcgttgggcggtcaagtggtcgccgcggtgggttgcgtaagagttgaagtcttcttcaggcaaacccattttcgccaaatactcgcctgcggcactgacggccaaaatcgcattggacggcgagaggtggtcggtggtgatgttgtcgggcaaaatcgccagcggacgcatacctcttaatgtgcgttcccctgccagcgcgccttcccagtaaggcggacggcggatgtaggtggacatcggacgccaatcgtacagcggactgggtgctttttgcgctgtgccggtgtcgaacatcggtacatacacatcgcggaactgctgcggtttcacatattcggcaacgacggcatcgatttcttcatcggcaggccaaatgtctttcaggcggatttccttgccgtctgcaacgccgagtacgtcgttttcaatatcgaaacggatactgcctgccagcgcgtaggcaacgaccaacggaggcgaagcgaggaaagcctgtttcgcatacgggtggatacggccgtcgaagttgcggttgcctgataatacggcggtggcgtacaaatcgcggtcgatgatttctttctggattttcggatccagcgcgccactcatgccgttgcaggtggtgcaggcgaaggcgacgataccgaagccgagtttttccatttcgggcaacaggcccgcttctttcaaatagatttcggctacttttgaacccggggcaaacgaagatttcacccaaggtttgcgtttcaagccgagacggttggcattgcgtgccaagagcgcggcggcaacaacgttgcgcgggttggaagtgttggtgcaactggtaatcgcggcgatgatgaccgagccgtcgggcatttggccgtccgaaggctcttcgtaaggcttcgccagccctttcgccgccaaatcggcggtcgcaaaacgggcatgcgggttacttgggcctgccatattgcgcgttacgctgctcaaatcaaatttcaaaacgcgaggataaacggcggttttcaaggcatctgcccacaagcctgcggttttggcgtaggtttccaccaatttcacctgcgcgtcgtcgcgtccggtcagtttcaaataatcaatggtttgctcatcaatagcgaacatcgcggcagtcgcgccgaactccggcgtcatgttggaaatggtcgcgcggtcgccgatagacaggcttctcgcgccctcgccgaagaattcgacaaacgccccgaccacgcgttctttgcgcagaaactcggtcagtgccaacacaatatccgtcgccgtaatgcccgcctgccgtttgccgttcagctcaacgccgacaatatcgggcaggcgcatcatggacgcgcgtcccagcattacggtttccgcttccaatccgcccacgcccacggaaatcacgcccaatgaatcgacgtgcggcgtatgtgagtcagtaccgacgcaggtatcggggaaagccacgccgtttttgacttggacgacgggcgacattttttctagattgatttggtgcatgatgccgttgcccgccggaatcacgtccacattttcaaacgcggtttttgtccagttgatgaagtggaaacggtcttcgttacggcggtcttcgatttcgcggtttttgcggaaggcatcaggatcgtaaccgccgcactccaccgccagagagtggtcgacgatgagctgggtttgcaccaccggattcactttggcaggatcgccgcctttttcggcaatcgcatcgcgcaggcctgccaaatccaccaacgcggtctgccccagaatatcgtggcacaccacccgcgccggataccacggaaagtcgatttcctgcttcccttctatcaactgccccagccagctttgcagcgtcggcaaatcgactttgtccgcgcggttgaccaaattctccgccaaaatgcggctcgtgtaaggcagcttgtcgtaagagccgggcttgatgtcctcacacgccgcacgcgcgtcgtagtattccaaatccgtaccgggcagcggtttgcggtaacgttggttggcagccatgtcggttctcctgtggatctgtttttcttgtggtttgaggtttcagccgacgttttgaaggggtcgtctgaaagggtttaaaacatcgaaacaatcatctgatacagcggatttctctcgtctatcaacaatttcacagccatcgaaatgctgatgacaatcagcagcggcttaatcagcttcgaaccgaagcggacggcaaatctcgcacctaaattcgcaccgacaaacgcaccgaccgccatcgttgccgcaatcgggaaaataatcgaaccgtgcagcaggaataccgatagcgaaccaagattgcaggcaacgttcgccaatttggtgtaagacatcgcgttcaacagcttgcagccgagcaaaacaataaaggcaatcagaaaaaacgagccgacacccggtccgaacacaccgtcgtaaaaacccaaaagcggtgcgaccgtcagcccgaacagaaaaaaagacattctggctttgccttccttactgccgtcgagcttgggcgaaaacacaaaatacagtgcgacaaatatcaacaaaaccggcacgaccgccagcagaatatctttggaaaccaagctgaccgataatgcaccggccacgccgcctacaaacgatgctgcggcaatcgggagacctttcttccaatcaatcaaacctttgcgtgcaaaagaaaccgtagctgaaaacgtagcagcggctgcttgcagcttgttggtggcaattgccgacacgggaggaatacctgccaacaagagtgcgggcagcgtaatcaaaccacccccgcccgcaatcgcatcgataaatccggcaatcatcgcaaccaaacccaaagcgagtattatatataaatcttccatgtttcttatcctgttacttgcgccaatacaggattatcttctcctattagattaaacttatttcagacaacctttccaataaggcaaggtcgtctgaaatccttagctttgcataccgaaattaaagaacaaactgctattgcattcttcaattatcgttcttcaatctccacaaacgccaaatcttcagggcctgtgtagtttgcgctcggacggatgattttgccgtctttgcgttgctcaagaacgtgtgcgctccaaccggttgtacgggaaattacgaacagcggtgtgaacatagcggtcggtacgcccaatttttggtaggaaacggcagagaaccagtccagattcgggaacatttttttctcttcccacatcacgctttccaaacgttcggcaatgtcaaagaggcgcatatcgccggtttctttgctcaaaccgcgtgccacttctttaatgacaacgttgcgagggtcggaaatggtgtacaccggatgaccgaaaccgatcacgatttctttgcggccgatgcgttcgcggatgtcggcttcagcttcgtcggcattgcggtagcgtttttgaatatcgtaagccacttcgttcgcgccgccgtgtttcggacctttcaacgcgccgattgctccggtaatgctggagtacatatcagagcctgtaccggcgatcacgcgggcggtaaaggtagaagcgttgaactcgtgttcggcatacagaatcagtgaaacgtgcatggctttgatgtgtgattcgcttgggcgtttgccgtgcaacagttgcaggaaatgaccgccgatggtctcttcgtcgctttcaacctcaatgcgtttgccgttgtgcgaatattgataccagtacaagaggatgctgccgaggctggcgatcagtttgtcggcgatgtcgcgcgcttcactttccggatggctttcacgttcaggatgaacgcagcccagcatggatacgccggtacgcattacgtccatcggatgggtatgtgcaggcaggctttccaaaactttaatcacacggataggcaggccgcgcatggatttgagcttggttttataagcggccagctcgaatttgttgggcagatggccgtgaatcagcaggtgggcgacttcttcaaactcgcatttttgtgccaaatccagaatgtcgtaaccgcgatagctcaaatcgttgccggtacggccaacggtacacaaagcggtattaccggccgcaacgccagaaagcgcaacggattttttaggtttgagggtcggggtttgagtagtttcagtcatggtatttctcctttgtgtttttatgggtttcgggttttcagacgaccgatgcggatttgttgaaaggcagtctgaaagcggtaaatcatttttgaaacaatttatccagtttttgctcgaaggcatgatagttcagatgctcgtacagctcggcacgggtttgcatactgtccaccaccgccgcctgagtgccatcgcgcataatcgcttcgtaaacattcagagcggctttgcttgctgcacggaacgatgacagcggatacagcaccagcgacacgccgttttcagccagctcgctttgggtataaagcggagtggaaccaaactcggtaatgttcgccaacacgggcactttcaccgcatctgcaaattggcggtacatgttcaaatcggtcatggcttcagggaaaatcatgtccgcaccggcttcgacacaagcttgggcgcgttcgatagcggcatccaaaccttctaccgccagcgcatcggtacgcgccataatcacgaagttctcatcaacgcgcgcatctacggcagctttgatacggtcgaccatttcatctttagatacaatggctttgttcggacggtggccgcagcgtttttgcgctacctgatcttcgatgtgaaccgctgcaacaccggcgcgttcaaagttgcgaatggtacgggcaatattgaatgcaccgccccaacccacatcgatgtccaccagcagaggcgtatccacgttgtccgtaatgcgtcgtgcgtcgatcagcacatcttccattgtggtaatgcccaaatcagggataccgcaagaacaggctgccacgccgccgccggacagatagatggctttgaaaccgctttgggtggccaatcgtgcaaaataagcattgacgcaaccggcgacggcaagcggattcgattctttcacggcttggcggaaacgtgctccggcagagtgttgactcatcatatttctcctttatagactttttttcagtatggacaggcttccatcacattcggacggcaaaacacagccatccgacgcgtcgggcatcccaatccaatcattaaaaatatatgggaaaaattatcttattgatatttaaaacgaatcaaagaaaaacagcagaccgttcggaattatgcggcaaaaccgcagacaagaagaaaacaaggggattattcagaaaaggggaaaacatctgaattggtttcatagtaatgttcctttgtagtgttatgtagttttatttttcgataatctaaaacacaagactgaaaatgtcaaacatttttaaggagactcattacataattttaatattttattttaattccatgattaaactagattaattttgaattatttgtttcaataaaattgtcaggaaatcaagaaaaatttttgataatcaaaatcctgaaaacttataaaatattttatacataaaaacaatgtattatttttaagcaatccgatgtattttattatgtatttgatttttatataatttaataaaaattaaatatatcggcaaacaaaatgccgtctgaaaacctttcagacggcatttttaatatcgaatcaatcagcccaaataccagaatttcagtgcccacaatacggcaacaatccataccataggcggaacgtctttggtgcggcggcataaaagtttaaccacggcataactgatgaagccgaaagcgatgccgtctgcaatcgaataagtaaacggcatgaaaacaatggtcaggaacgcaggtgcggcttccgtcatatcgtcccaatcaatatccctcgcactgcggagcatctgcgtgccgacataaagcagggcgggcgcggtggcaaaagcgggaacacttttcgccaaaggtgaaaacatcaggcaggcgagcatcaatacgccgacggtaaccgccgtcaggccggtccgtccgcctgccgatacgcccgccgcgctttccacataaggcgtggtggaagaagtacccaaagccgcacctgccacaatggcggtagagtctgcaagcagtgcgcgtttcaggcggggcagcttaccgtccaccagcagcccggcacggtgggatatgccgaccagcgttccggtactgtcaaatagatcgaccaagaagaagacgaaaatcacactgaccatgctgacggtaaacaggccttcaaaatccatctgcataaaagtcggcgcaatgctcggtacttcgccgatgatgccgtgaaattcattcaaacccatcaggctggcaatgacggtaatggtcaagatggtgatgatgattgcgccttgaacgcggaaatgtcccaatacgaccaccatagcaaaaccgaacaatgccaacaacgcggacggctgatgaatatcgcccaaaccgaccaaggttgccggattggcaacgataatgcctgcgcctttcagggaaatcagtgccaaaaacaaaccgataccggcagcaatcgacattttcaaacccataggcagtgcgttgaccagcatttccctgactttaaaaaagctgaacaggataaaaatcagaccggagatgaacaccgcacccaacgcaacctgccaaggcacgcccatacccttaacgacggcaaaggtgaaataggcattcagccccatccccggtgcgagtgcaatcggatagttgccgacaaaacccataacaaaacagccgatggcagacgcgatacaggtagcgacgaataccgcccccatatccatgccggtctcgcccaaaatcagagggttgacgataacgatgtagcacatcgtcaaaaaagttgtcaaacccgccatcaactcggtacgcaccgtcgtaccgtttgccttcagcttaaaaatcccgtccaacagtgtttgttttgaagtgtccatatctgaaagtctgtatcaagtggaaaaatctgaatccgccgaccgcaaaccgtacgaaattgcaacatcttgaaaaacatacctcccaaaccggacaaaccgattcgggaggcagcaggtttacgggcaaacagcacattatttgtctgaattgtgttgacgacgcaaaatcgcagggatttcaaagtcgtcaagtacggactgattgtcgaaatccgcagcggtaaggttcatcgtgcggataccgcgattggtgcggatcataccttcgacattgtggctttgctcctgtttggacggagcaaccgcttctacctcccttgccggaacaaaatcgaccgcgcctttttctttcagaccggtagcgataatggtaatccggatggcatcttcgctcatggtctcgtcttcagccgcaccgaatttgcattccaaatcgggatgcgcgctttggttgacgattttcatgacttcggacaactcggacattttcaagcaacccggagcagtcgtaatattgaccagcacaccgcgcgctccgtccaaggttacatcgtccagcagcggactggaaatggcctggtcggtcgccatacgcgcacggtcgataccttgggcataacccgaacccatcatagcgataccgcggttgctcatcacggttttcacgtcggcaaagtcgaggttgatgatttcgctcgggcaagttaccacttcggaaatgcctgcgaccgcatcgcgcaatacattgtcggcggcacggaaggcttcgcgcatcgttacgtcttcacccaatgcagtcatcagtttgtcgttcgggatgataatcagcgaatcgacgtgttctttcaactgttccaaccctgcctgtgcgacatggacgcgcttaccttcatatgcgaacggtcgggtaaccacggcaacggtcagaatgcccaaagacttggcaatctcagcaacaaccggcgcggaaccggtaccggtaccgccgcccataccggtcgtgataaacagcatattcgcaccgcgaatggcttcttcaatggcttcccggtcttcctgggctgccgcacggccgatatcgggattcgcgcccgcgcccaaaccgcgtgtcagattcgtacccaactggattctcttcgccgcatggttttttgccagagactgcgcatccgtattggcactgataaactccacaccgcgcacattgttggcaaccatgttattgattgcattgcaaccgccgccgcccaagccgattactttaatcaccgcagggctgactgccgattctgccacgtcgtaaacaaattccattcaaaaactcctgctcgccccattcagaggacggtttaaataaattattattcattatataagaagtatcttgctgctggcaaaatacttctcacctgtcaaacggcaatccacctgttcagaagctgttttcaatccaccgtttcaatcttgccaacaaaccgccgcccccttccctctcttgcactgcaccgttttccggctgcggcaagtttccttccagcttgcatgctgcatgaagcagcccgatagcggtagaaaaacgcggtgtgcggacgcggtcggacaaaccgcccatttcttggggtgcaccggtgcgtacaggcaaatcgaagattttttcggcaaattccacaatcccggtcatcatggacacaccgccggtcagaacgatacccgcattcagcacttctttggggaaacccgatttttgcagctcgcccagcactacgccaaaaatctcctgaatccgtgcactgatgattgctgccagaaccttactggaaacctgacgcgatgtccggtcacccacgcccggaacttcaatcatctcacccaagccttccgtatcgcatgatgccacgccataatggattttaatgtactcggcggcatcgagaggtgttctcaacgatttggacaaatctttggtaatcagattaccaccggccggaatgacggacgtatggcggatggcaccgttcatataaacggcaatatcggtcgttccgccaccaatgtcgatgacgcatacgccgaggtctttttcatcttcagtcagcaccgcctgcccgcttgccaacggctgaagcatgatctgatcgcttttcaaaccgcaccgctcgatacatttttggacattctgcactgccgtacttgcaccggtaatgatgtgcacccgcgtatccagacgcacaccgctcataccgatgggctccctcacgccaagttgggtgtcaataatgtagtcttgaaccacggcatcgagaattttttgatcgggcgggatattgattgcctttgccgtttcaatggcgcgatcgatgtctgcctgcgtgacttccccatctttaattttaaccacaccttgcgaattgagactgcggatgtggttgcctgcgatacctgtggtaacgtgagtaattttggtatccgccatcagctcggcatcattgaccgcctgcctgatggcttggacggtggcatcgatattggttaccatgcccgcgcgcaagccccgtgaaggagcctgccccaaaccgacgatgttgattttgtcgtcatcttgaacttccccgatcagtgcgaggactttagacgtaccgatatccagtacgctgatgtatctttgctgctgttccattgttcgtctgctcttaaaactgattgaaatttgcgtcgcaccgtttcagacggcacggccgtaatctgtccgatacctgttcccactattcttcggattctttttcgggtaaaccgtcggaagcatagcggactgaaaatccgtccttatacctcatatccacataggataaccgatttttatttttacgcaacagatgctgccacgcttcggtaaaaagccggaggcgtttcatctcgttttcccgtccgagcctgacggtgatgccgttgtccaaaacgacaatccacgccgaacgtgccgtataggtcatctctttgatgcccaaaccctgttttgccaaaacagtcgaaaattcgtcataacggcggagcatttcggcagacgttccttccgcgcctctgaataccggcattccgggtctgtccaagcgggcttcaaaaacattgccttcgccgtccaccaaggcatggtcgccccaacgcgcgaccggcttgcgctcggtcaggacgacctcaaccgtgtcgggaaaacggcggcgcaccatgaccgacgcaatccacggataccggcggtaggcctcctgtgcgccattgatgtccgtcctcaaaatattcccatggatgtattctttcgccaaactgcccaatgtcttcttatcggaataaaccaggttgcccttcagcgacacctgcttgacgggcagatgattcgaattgtaaaaccaaaccagcccggacgcagcaagcagcatcgccatcatgacaagcagccagcgcgtcagccgttccatcgcttcggcattatcccacatgtgcggtcttcaaaatttcaatacataaatcggcaaaacccacgcccgtaacggcagcggatttcggtactaaactatggctcgtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcaaatcttccgaaggacattgataaatggtgtcgtcgcggttgtacttggcttcgtagtcgtaaaactcggttgcgggaatgatgtgtatgccgggcagccctttgccgttcaggacggggcaggaatattcgccgccgccgataaaacgttcggcaatgatttcgccctgaaggtgtttcaattcttcgtaaacgcttttcagacggccttttcctttgacttttaccacgcctacgctgctgccttcggccgccggtttcacaaacatcggcaggcccaatttttcttcgacggcatcgaaatcagtgtcgtcgtgcaggacggcgaactcgggaacgggcaatcccaatgcctgccaaatcagtttgcagcggtatttgtccatgccgatggcggatgcggcgacaccgctgccggtatagggaatgcccaacagttccaatgcaccctgaaccgccccgtcttcgccgtaagtaccgtgaaggatgttgaatgccgtctgaaaaccttgtgccttcaattcagacaatggggtttctttaggatcgaaggcgtatgcgtctatgcctttgctttttaaagcattcaaaatggcggtgccgctgtccagcgagatttctcgttcgctggaaaaaccgcccatcaatacggccactttgccaaaattctgcattgtttttgttctttcctgattgctttatgcttgttgccagaggtcgtctgaaacctgatttgcggtttcagacgatctttatatgatgttccgtctgtcaggcgggtgtgcctcaaatctgtttcgacaatgccagcagcgcggcggggacgcggttgatgcttcccgcgcccatattcaacacgatgtcgccgtcctgcaaaacgttcaacagcatttcgggcagatcggcaacgttttcgcagtaaatcggctcgagtttgcccaacacgcggatggcgcgggcaagagcgcgggaatcggcggcggcaatcggctcttcaccggcggcataaacttcggtcagcaccagcgcgtcaacggtattgaggactttggtaaagtcttcaaacaaatcgcgcgtgcgggtatagcggtgcggctggaaggcgagtaccaaacgtttttccagatacgcgccgcgtgcggcggcaagggtcgccgccatttcgacggggtggtgtccgtagtcgtccaccaagagcgcggtcccgccgtttggcaacttgatgtcgccgtatttttggaagcggcggccgacgccttcaaagccgagcaagcctttttggatcgcttcaaccgatgcgccgacttccagcgccacgccgatggctgccaatgcgttcagcacgttgtgtctgccgggcatattcagcacgacttcaaacgacccctgctcatgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagtttttcgacgctgtgcccgtaggtatccatatggtcttcgtcgatattggtaacgacggacataatcggtgtcaggtgcagaaaggatgcatccgactcgtcggcttcggcaacgatgtattcgcctttgcccaagcgggcgttagtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttcggcggtatggccgggataaacttgaatgcccaggctgcccaaatgctcggtagcggcatttcgcgcctgatccgaaccggaaactttaaagcccaaattgtgcaagacttcggcgatgccgctcatgccgacgccgccgataccgacaaaatggatgttggtaactcgatttttcatcataatgttgcgttccggtggattttcgatgcgtaaaggcgttattttaaagggctgaccgtttgcgcgccatagttttctgacaaatatatagcggattgaaataaaaaacatccatgccgtctgaacggcttttcagacggcatggttcggcagtttacgccgcacacgcaatcgcggcttccgccacgtcgtccgcactgtgcggcagtgccaacgtacgggcgttttctgcccatttgaggcatttttcgcggtttaagccgccgagaatctcggcgagtttttccgccgtcaactgggtttgcggcaacagcaatcccgcctccgcctgcaccataaaacgcgcgttggcggtttggtgatcgtcaaccgcgtgaggatacggcactaacaacgcacccaatcccgccgccgtcaactcggcaatcgtcagcgcgccggcacggcaaatcaccaaatcggcatcgcggtaggcggacaccatgtcggtaataaattccacgcattcggctttcacgcccagcgcgtcgtaatccgcctgcaagctgcccagcttgccccgtcccgattggtggtacatctgcggacgcgcattgtcgggcagcaaagccaatgcctgcggtacggttttgttcaaaacgtccgcgcccaaactgccgccgaccaccaaaattttcagacggccttcacgcccttggaagcgttcggcaggcacgggcaggttgctaatatcggcgcggacggggttgccgaccaagccgccttcgtggctgaacgctttcggaaaagcgtacaacacccgcttcgcccagcgcgacaggtggcggttggacaaacctgccacggcgttttgctcgtgaatcacaatcggcacgcctaatagcttcgccgccaaaccgccggggaaggtaacgaagccgccgaagccgatgacgcactcgacacggtgtttgcggataatccgctgcgcttcgcggacggtttgatacaaagtaaccggcagcatcagtttgcgtttgatgccgttgccgcgcacgcctttaatcgccagcgtttccaagcgtatgccgtattgcggcacgatacgctcttccatcgaatccttgctgcccagccaaatcacatgatggccgcgcgcgcgcaatgaatccgccaccgccagcgcggggaaaatatgtccgcccgttccgcccgccatcagcataaaggttttaccgcccatgatttactccacccgataaccgcgcattttccggcggttttcataatctatacgcaacagcagcatcatgctgatcagcatgaaaaagactgacgaaccgccataggacatcaacggcagcgtcagacctttkgtcggcaaagcaccgatataggcgttgaaagtcaaacccaaatcgcgcgactgcttgccgatggaaaacgcccgcaccaccagccagccgtaacagaatatcagcacgcacataccgaagaaaccgaattcttcggcgatgatggcaaaaataaaatcggtatgcgcttccggcagaaagccgcgtttgctcaaactcgcacccaaacccataccgaaccactctccgcgcccgattgccatcagagagtgggtaagctggtagccggcaccctgcgggtctttccacgggtccaaaaatgccactacccgctgcacacggtagggagcggcggtaatcatcagcaccatcccgcccaagacgctgcctaccaggacgaaaaaatatttccacggcaatcctgccaaaaacagcattccaacggcaatgacggtaatgacgacaaacgaaccgaaatccggctgtaccattatcagcaccaaaccgaacgccaccagcataatcggcaggatgatcgcccggaaacggccgtacatttctaatgtttcacgacgtgcctgcggattggtggcggacatgatcagattggccgtcccccgccaaatcgactgccaacccaaactttccatgctgcgcaacacttcttcacggcgcgtgaacaggcttgccaaataaaggatgaccgccagcttgaacagctcggtcggctggaaattcaacggacccaaaggtatccaacgggtcgcgccattgatttcgcgcccggcaatcaatacgactaccagcaacaggccggatagggcaaaaatccacggcacaagccgccgccatgtcctcatcctgcaaagaaaccataacaaaccgctcgctatcaagccggcaacgacgaaccccgcctgtctggtcaaatagaaaaactgatcgccgccttcttttgatgccaaatacacagaagccgaataaatcatcagcaggctgaacgccgtcatcagcaccaccatccacaaaagcggcgcgtcgaatttcctgccgtcgcgcacaatcggcctgtcgagcagcagagtgtggacaccgtcgcccacttttaccaatacttccgaaatcttcaaaaaaaccacctgccagtctgtttgcacctgccgcaaagggcaaaaatttcagacggcagacaatgccgtccgaacatacgatacatcccaaatcggtattctaaatctttacttgccgcccaacaatgacggcgtttgcatttcagacggcatcacaaagccttaaacgcttcgataaacacttccgaacggtgcgcgtagcctttgaacatatcaaagctcgcgcaggcggggctgagcaacacaatatcgcctgcttcggcttgggcatatgccgtctgaacggcttctcccaaagtggcgcagtcggtcatattcaagccgcagccgtccaaatcgcggcggatttgcggcgcatcgacaccaatcaagaacacgccttttgccttgcctaccagtgcatcgcgcaggggcgtgaagtcctgccctttacccatgccgcccaaaatcacgaagagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccacggcagccatgacgttagcggcgttgtgcagaccttgcaacggaatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttgaacgcctcaatatccggctgccgctcgctgatgccgggactgagagccagaatatcgaaaccgttgtccagcgcatctttcagacggcccgtgtaaaacaccaacccgtcaaacatcttaccgatttgcgacacgcgttccggcttcagctccgcatcatacgcagcaacctccgcgccgtttttgcgcaggtaggcaatcatggaaatacccgtaccgccgagtccggcgacgaggatttttttgttttgaaaagtcattttggtttgtcctaaaacaaatcatattgagcaggagatgtccgcccctgcccaagccgctttcagacggcatcgcgagctgttcaataacccgccttcaggcgttggtcattgtcgcagccgtcttggtctccgttttgacaagccttgccaaaccattcttgtgcaagggcgcggtcttggcgcacgccgcgtctttcggcatacatcacgcccaaattgttttgggcttgggctaccccctgcgctgccgcctgccgaaaccatctgaccgcttcgacatcgtcttggcgcactccacgtccttcggcatatatcacgcccaaattgtattgggcttggacaaccccctgcgctgccgcctgccgataccatctgaccgcttcggtatcatcttggcgcacgccgcgcccgttggcatacatccagcccaaattgtattgggcttgggctaacccctgttccgccgcctgccgataccatctgaccgcttcagcatcatcccggcgcacgccgcgtcctttgtaatacattgcgcccaaattgtattgggctgctgcatttccctgtgctgccgcctgcaagttttcccgaaaatccgatacgtcatccgcccacaccgctcggttcaagcccaaggcaatcagggcggcggcaagccatttgactgtctgtttcatggttttacttctgttttagtataaggcgggtttcagccaccgttaacgatagggctgggcggattgtcgccgcaggtttattgcgcgttcaaatgccgtctgaaagatgttcagacggcataggttcagcggattttgagggtactcaaaccgatcaacaccaagacgatggtaataatccaaaagcggacgacgacttgggtttctttccagcctttttgttcgtagtggtgatggatgggcgccatcaggaagatgcgttttttggttttcttataccagccaacctgaagcataacggatacggcttctacgacaaataatccgcccataatgacgaggacaaactcttggcggacgataacggcgacggtaccgagcgcggcacccaatgccaatgcaccgacatcgcccataaagacttgcgcgggataggcgttaaaccacaagaaaccgaggcacgcgccgcacatggcggtacagaaaatcaccacttcgtttgcgccggcaacgtaaggtaattgcaggtattgggcaaattgtgagtggccgctggcataggcgaagatggcgaggccggcggcaacgaggacgacggggaaggtcgcaaggccgtccaagccgtcggtgaggttgacggcattggatgtgccgacgatggtcaggtaagacaacaccaaaaagccgaccacgcccagcggcagggcgatttgtttgaagaacgggacaatcaaaatattgttggcggaattggcggcaaggtaaaacaatgccaaactggcgataatggcaacgcttgactgccacaccattttgaatttggcggacacgccgttggggtctttatagacgactttgcgccagtcgtcgtaaaaaccgagtgcgcccgtggcgagcaatacgcccaagagaatccagatatacgggtttgcccagttgccccacaacagggtggacacggtaatggcggtcagaatcagcgaaccgcccatcgtcggcgtgccgtttttgacgaggtgggtttgcggaccgtcggtacgcactgcctgcccgcatttgagcgcggtcagcctgcgtatcgtccacgggccgaacatcagggaaaacgctaaggcggtcaacgccgccatgacggcgcggaatgtggtgtattgaaaaatattcagaccggttaaccagttgctgaaatgtgcgagccataaaaacatggggcttcctttttttgttttgtcgttatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatacatcgggcctgcgcccgtttgaggttggcttgccgcccggcaaggtttcggacggcttttgcagattaacgtgcagggactttctcaatcacgcaaattgggtaactccccggatttttaccgccgcccaagtctaaacataaatcttcataaagatacgcctgcgtccgcattccggcataaaacgcgccgaccagcgcggcaatcagcaataaggctttaaaaaaacgtcggcttttcattttcacttatcctccaatgcctcgaccacttcttccatctgcataaagcgcgaacctttcaccaacacggtggcgcgttcgggcaaatcgtggcgcaacacttgaatcaacgggtctttggcggcgaaccacaaaccgtccgcgccaaatttttccgccgcttcgacgctgttgtcgccgacaaaataagccgcttcgatgccttggtcgcgggcatacgcgccgacttcggcgtgcatagcggcggcttcgtcctcgcccagttcgcccagttcgcccatatcgcccatcacgaaaatacgcggcgcaggcatacgcgccaacacgtcaatcgcagctttcatgctgtcagggttcgcattataagtatcgtcaatcagggttgcgcccttgattccggatttgacgttcagacggcctttgatattgctgaagcctttcaaaccttccgccacatcgttcaaactcaaacccgcagccaaagccagcgcggcggcagcggcggcgttgtggacattgtggcggccgggaacaggcagcaccacggcggcgcgctcatcgccgcacaccaaatcaaattcgcacgacaacggtttcagcacaatattttccgcgtgaacatcgccgctatcgatgccgaaagtgcgcgtattcaaattaagcgttgccgttttgaagacagccatattggcatcttcttgaggaatcagtgcaatgccgtctgaacataaaccttggtaaatctcgcttttcgctttggcaatatcgcccactccgtcgaaaccgcagccgacatgggcgcgcatggcgttgttgaccaatgcggcatttggtttggcgatttgcgttaaaaccgccagttcgccgaaatggttcatgcccatttcaatcacggcatagcggtgtttttcgtttaacttcaacaaagtcagcggcaatccgatatggttgttgaagttgcctgccgtcgccaacacggcatcatcgccgaaacggcggcgcaataccgcagccagcatttccttcaccgtcgtcttgccgcccgaaccggtaatgccgaacacaaacggattcacattttcacgccacgcctttgccagcgtttgcaatgcggcaagcgtgtcatcgactttcaacgcgccatccattgcagcacaatcttcgcgcgaaaccacaaccgccgccgcaccagcagccaatacgtcttcaacaaaatcatgcgcgtcaaaccgctcgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggcattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaaaaaattaaacgcgctgcgcctcactttaatcatttcgcgccgcgtgtcatcggacgaaattttaaccagcggcacgccgtagctttgacgcttccacgcaccatgtgtcaacgttcgctcgccgcctttaccgacatgcatcaaaccgtggtcggaaaagtaaaccaaagaccagctttctttattttcattcaatatcttaactgtatcttctaaaaatttatcggtttgcgcgatggtggaaacatagcaggatattttttcagtttgatactgaaaccgccgcgcatccttatccaaacgtgtgcaaaaatcactgtgcgaacccatcaggtgcatcacaatcagccgaggcttcgtgcctgcatttcctatcaaaacccgtttgaacgccggcaacaaaaggcggtcgctcaaccccgcgcttttgccataatcacccctttgggtaaaccacggataatcgctgcgtagggcataggtggaaatttcgttggcaaaatgccccaacattccttgattagacagccacgccgtccgaaaacccgcctgcttcgccaagctgacgatgttattgttcggttctcccggcagccccaaagtctgcggcagcgaaagattcgtcgcgtgggcggtcgattggtaaccgtttatcaacagccctttggtctgactcaaaaaaggcgtatcgggcaatgggaaaccgtaaacattcatataatccgaacgcgcgctctcaccgataaccacaacataatttttatacttgggcgcaacatgacggatatgccatgttgacgctttttttgctgcttccaaaatgtgggcgcgcttggcggcatattgtgccggcgcggaagccaaatcgtaatacaggtcgaaaatattcaacaacaggccggcatcaggttctcgcaaatctttatcgctggcgattttatccatcaccgcgcaggacaaaatcaaagtcaataatatagtcagccatattttgctgcggcgtttatagttttttacgtcagcaaatacccccccccgatacacaatatttccaaactgtcaagccaaaaatgaaaaataatgcctgcacaaaataaagcgacccgggaagattgccgacaaattcacgcgcctcggcaggattgctttccaatatcgaaccgactatctgataagacggcgcaccatacagccagccgaccggcaaatatagggcggttgtgccgacgtaaatcagtaaaacaactgaagaaacgcgcgggaaaccgcgtgccaataataataaaaatacaaccgaagccaaagcacccacggcagaataacggtagccgtattcatattccaagtgataacctgatgcgatggccgcgccaaaacaaaaggctaaaagcgcgcaaatgcccaatgtattttttaatgtctgattcatattttttattcgggcggattgtttcatacgatgccgtccgaatatcccattatttacgagttaacaaagcctgtccgacgatttcaagatcggaaaaacggtgcttcacgccttgtacatcctgatagttttcatgccctttgccggcaatcaggatgatgtcgtttgcggcggcttgttcaaccgcataacggacggcggcggcacggtcggcttcgacgcattcgggcgcgggaacggcaggcaggatgtcgttgatgatgtcgtgcggattttccaaacgcgggttgtcgctggtgacgacgactttatccgcgccctgtacggctgccgcgcccatcagcgggcgtttgccgcgatcgcggttgccgccgcaaccgaatacgcaccataaagccgcaccctgcggtttgatttcctgcaaggtggcgagtgctttttccaatgcgtcgggcgtgtgggcataatcgacaacgaccaagggcttgccgctgttcatgatgcagtccatgcgccctgaagcgggacggatttttgccagcacatccaataccttatcaagcggatagccgttggcgcacagcaaggcgatgcaggcggcgaggttttgcgcgttgaaccgtccgagcaggcgcgtgcggcatttcccttcgccccacggggtttggaatacggctgctatgccgtctgaagaggcggtaaagtcggtaatgcggatgtcggcgtgttcgctgaaaccatagctgtaaacggccaaatcgggacagtcttttttcagacgacctacgagttccgcgccgtattcgtcatccacgttgatgactgcgtgtttcaagccgtgccagtaaaacaggcgcgacttgatggcaccgtaggcttccatcgtgccgtggtagtcgaggtggtcgcgggtgaggttggtaaagattgcgctgcggaatgacacgccgttgacgcgcgactggtcaagcccgtggctggagacttccatcgcggcgactgttgcgccttgttgacggaaacggtagagcagggtttggacatcgacgggggcgggtgtggtatgcgtggtttcttccaatgcaccccaaaagccgttgccgaccgtgccgacaatggcggttttttcgcccaacaaatcggcagcttgcgccagccattgtgtgatggaggttttgccgttggttccggctacgccccaaactttgaggccgtctgaaacgttgccgtaaacttgcgccgccaatatgccggcacggtgtttcaaatctttgatgccttgattggggactttccattcgggattccacgcaaatttgccgtcgtcgtcccaaaaaacaaaagccgcgccgttggcaacggcggcggggatataactgcgtccgtcggcatattcgcccggacaggcaacgaaaatatcgccttgtttgatttggcggctgtctgaatgcaacaaacgccctgccgcgtttgcacacgacagagtcgggatgccggtttcagccaaaggggttaacttgctgaacataaaacaatctcgttgatactcggattaagacggtgttttgacggctgcggcggtcagtggcttggtcggggaaatgcccaagatgttcaggctgccgcccataatttttttgaagggcggccctgccactacgccgccgtaataaccgtgggcagtcggttcgtcaatggttaccgccacaatcacacggggatttttggcgggggcaaaaccgataaaggtagcgatgtgtttgttgtcggcataacgcccgttgacgaacttgcgcgccgtgccggttttcgcgccgacatcgaaaccgtccaccgcacccgccgtaccggtgccgcccggctcggttacggaaaccatcagattgcgtacctcgcgcgcggtcgattctttgaatatgcgtttgccttgcggcgcaaccgcctgtttttcaaagctgaccggcagtaaaacgccgtcgtgcgtcagtgcggtataggcgcgcgccaattgcagcaggctcaattgcaggccgtaaccgaaagacatcgtcgcctgttcgataggccgccacctgcgccaatttctcaacaaacctgcagtttcgcccggaaagcccgagtgcatacgcacaccgatgcccaactcatgatagaagtcatacatttcttcggcaccgaaacgcgcagacagtttgcttgtgccgacgttggacgatttctgcatgatgccgcgcacatccaaagaggggtaaacatgggtatcgcgcacgggagacggtccgattttataaggctgcgtattcagccgttcgttcaaatcggttttgcccgcatccaatgccttcgcaatcacaaacggtttgattgccgaaccgggttcgatcatatcggttacggcacggttgcgccgctgttcgctgtctgcccggccgggcctgttgggatcgtaggcgggcgtattggccaaggcgaggatttcccccgtgcgggcatccaaaaccaccaccgttccggcttttgcctgatggtattcgaccgccttgttcaactcttcataggccaaggtctgaatcctctgatcgagggaaaggatgatgtctttgccgtttttcggggctttattgcgcggggagtccaagctgtccacaatattgccctgccggtcccgcaaaacgacttccgcgccgtcttcgccatgcaggctgtcttcaagcgaaagttccaaaccttcctgacctttgccgtcaatatcggtaaatccgatgacgtgtgcaaacaggttgcccatcgggtaatggcgttttaattctttttcaaatacaaagttttccaaacccaaggctttgacctcttcggcaaccttgggatcgagctgccgcttaatccagataaacgacttgcctttctgttcgagcttgttcctcaaaacatcaaccggcacatcgacaagctcggacaggcgttccaattgtgcggcagacggcatttccttcatctctttaggcacggcaaacagggactccgtcggcgcactcaacgccaaaaccgcaccgttccggtccgaaaccgtaccgcgtgtagccggcaatgtttgagtccgcacaatccggttgtcgccctgttctttcaaaaagttatacgttaccgtctgcagatacagtccgcgagcaatcagaccggcaaacaagaccgctattgccatcaggacgaagctgatccgtccgttactggtcatcggctttttgacctgctcttctttgggcagcatccgaggcttatattcgctcttaatcaacatttttacttctcgttattattatcctgacgcaggaatccgattccggcacacaggctgcttctatctttgatgctccaccataaaggtattgcccgaaaccggcggatggaggttttgtttttctgccgccgccctgatcgcttcgtggttcgccaaacgcgcctgttgcagcctcatttgcgcataatcctgctccaaggcgatttcctgttttttcgccttatccaaagctgtgaaattgagcctgtactggttttgctgcatcacaacggaaaaagcggaaacgcacaccgcaagcagcagaaggaaattcaatttgttcattgccattcagacgtttttctctgtgattgttccggtatcggaccggcagtccgctccgccacacgcaaaaccgcacttctcgccctcggattggcggcaatttccgcctcacccggctttaatgccctgcccacgattttcaggggcagctcgggcaaatccgcttccctgaccgccgcccagcgcggcaggggcgcgtgttgcgaatattttttgacaaactgcttcacaatgcgatcttccaacgaatggaaagcaatgaccgccaaacgtccgccctctttcagacgacacatgacctgcggcaatactgcccctacttcttcaagctcgcggttaataaagatgcggaccgcctggaaggtgcgcgtcgcaggatcctgcccccgctcgcgagtacggacgttttgtgccacgatctgcgccagcttgcgggttgtatcgattggactttccgcccgttgcgcaacaatggcgcgcgcaatccggcggctaaaccgctcttcaccataattcttgattacctcgtgcaaatcctgttccgacgcaaccgctatccactctgcggcagacataccgcgcgtcgtatccatacgcatatccaaaggggcatcgaaacggaagctgaaaccgcggctgccgtcatcgatttgcggggacgaaatccccaaatcaaacagcgcaccgtccaccttgccgatacccaaaccgtccaatgccgtctgaaacgaagcaaaaccgccatgcacgacaccgacccgtttgtccgaacgcgccagctcttctgccacagcaatcgcctgcgggtctttgtcgaaaacaatcaaccgccccgcatcgcccaaacgcgacaaaatcagccgggaatgccctcccctgccgaacgtaccgtccacatagacaccgtcttcgcgcacggcaagcgcatccaccgcctcattcagcaagaccgtgatatgccggtaactttctgctccactcacaattgcaaatccgtctgactcaactggaaggcaagttcgtcaggatcgtcatccaaagcctgaaccatctcagcctcccactgctcgcgaccccaaagctccaaacggttggcacgaccgaccaaaacgacttcacggtcgaaatccaccctcttcctcagtccggcagaaaccagcacccggccggcgctgtcccattccaaaatttccgcgttatgcagcaaaagattttgaaaccgccgcaaaacagggttatccgccacttttaagtttaaaagttgcgccgcaaccttttcccactccgcaacagggtacatcaacagcttgtgtttcgactcgagcgttaccactacggcaggcgtatagaggcgcgacagaatgtcacggaatttggcaggaacagccaaccgccccttactgtcgatgcttaattcgtgtgcgccgccgaacatgacatgtcccaagccgaaatcaaaatcacaagggtaaaagagacactttgccccacaattccccaccaatcgacactataagaaattttaaacactcggtcaaatcagggcatgaaaactcattaacatatctgaaatttttattccttttaaaaacaataagataaaaaatgacgacaacggcacggcgggtgcggtacagaataatcgaaccaataaacaactatatatgattaatttaataatataaacacaatatatagtattaagataaagccatgacagcacccgtaccaacgtgtaatatgtcgggaaatccaataaatttacacaagctaacacttatcatgcccctcccctctcccgaagcacggcaattctcgctcaaactgcaaaccctcattgccgaaaaaatcggcaaacacggcaactggattccattttcacgttttatggaattggttttatacgctccgcaatacggctactacaccggcggcagccataaaatcggcaataccggggattttattaccgcaccgaccctcacctctctgtttgcacagacactggcacgccaacttcaagaacttctatcccaaacggcgggcaatatctatgaattcggcgcgggaaccggacagcttgccgccgatttgttgggcagcatttcggacggcatcagccgttactatattattgaaatatcgccggagctggcagcacgtcagaaaaacctgattcaagcacgcgcaccggaagcatctcaaaaagttgtccacttgaccgcacttcccgaagcgtttgacggcatcatcatcggcaacgaagtactcgatgccatgcctgtcgaaatcgtccgtaaaaatgaaggcggctcattcgagcatgtcggcgtttgcctagataatgaccgttttacctattcggcacgaccgctgcacgacttgcagctatctgccttggcttccctctattttcctcaaacagattatccctataccagcgaactacatccgcaacaatatgcctttatccgcacccttgcctcaagactcgaacacggctgcatgatattcatcgactacggttttgatgcagcgcagtattaccaccctcaacgcaatcaaggtactctgatcggacactaccgacatcacattatccacaatccttttgacttcatcggattggccgacctgaccgcacatgtcaactttaccgacattgcacaagcagggacggatgccggattagatttgataggttaccttccccaatcccatttcttattgaacttgggcattaccgagctattggcacagacggggaaaacggattcggcagcctacatctgtgaagctgctgccgttcagaaactgattgaccagcatgaaatgggcgaactgtttaaagtcatcgcattcggaaaaaatatcggcatcgactgggcaggattccgcttcggcgacatctgccacaaactctaaccctcatgccgcctgaatccgcttcagacggcataaactttttaacatttaaaaacagtcaactaattcaaaattaaaaaatacggcttgtcaaaaaaacagaaaaacatataatagcgtcttcacgaaacggcgaattagctcagtcggttagagcagaggaatcataatccttgtgtccggggttcgagtccctgattcgccaccaaattttcgggggtatagctcagttggtagagcgcttgcatggcatgcaagaggtcagcggttcgatcccgcttacctccaccagataaaaaagcacagaccgtaaaaaggtatgtgcttttttattgcctgattgccagcaaataaagaataaaccactgccttcaaaacaggcaatcgactttaaacctatcgccccgcctgtcctgattttatagtgaattaaatttaaaccggtacagcgttggctcgccttgccgtactatctgcggcttcgtcgccttgtcctgatttttgttaattcactatatcagcccgccagacaaacccgacccgaataatgtcttcaggtcgggtttatggtttcattcccaacttatccagcctgacagccacaatataatgatggcaataccaaaaacaatgcggtaataggcaaaaggaatataatttttcttggaaacaaacctcagcaacgcttttaccgctaccaagcctgaaacaaaggcagcaataaagcctatcagaatcaaaccgacatcatgcagggtgaaaaatcggtaatgtttcaggacatcataagccgttgcggcaaccatcatcggcacagccaagaaaaacgagaattctgtcgcagttttccgttcgatgccccaaagcatcccgcccataatcgtactgcccgaacgggacgtacccggaaccagtgcaaacacttgggcaacgccgatcatcaaggcatcaatcggacgcaatgcatcaacatcggcaattttaggctctgctcggctttggcgtttctccacccacaaaataaaaaaaccgcccaaaaccagcatgactgcaacactcaaggggttaaacagatactctttgatttgtttgccgaacaacagccccatcacggcggcaggtataaaagcaatggcaagattaaggacgaagcggttggctttccggtcttttcccaagccgtgcaacacattgctgaaacgttgccggtattcaaacactaccgccaaaactgcaccgagctggatggcaatttcaaaaaccttgtgattgctgtgaaaaccaatcagattgccgaacacaatcaaatgtccggtgctggaaatcggtaaaaattcggtaaaaccttctaccaagcccatcatcagggctttcaggacaatcagaaaatccattgcttgcgcttctttcggatacgggagttcggctatttctgtacagcaggggtctgacgcttgcgttcttccctgactttggcaaccaattctttaatcgtatgaacgccgccgtcaaagccgttattgaagataacgcggtattttccgccgacaataacggtcggcgtgctgtcgatgcggtattgttccgtcagtttctgcatttttaatgcggcggcggcagcttcgggggaatcataggcgcgcatcagttttttgccgtcaaagcctttttgagacaaagcccattttccggcaaccgacctgttttccaagcggattttttgttcgtaaactgctttaaacacagcagggtttgcctgatatttcaaacccgacaaattgacggcagccgccatcctagccaaaccgagcatttcaggctgccagaccacgtgctccgtcctcaaataggcatcagacggcaatgccttgcccagtttcaataacaaaggatcgaaatgatggcaatgtacgcagaaatagccgaaaaattccaaaacctcaattttacccgactgttcttgaggaatgggtttatccaacacaagatagtcttccccttccgtcagggcatatgcctgcgcggacaacactgccgacagcagcagcggcaacagatgtttgagcttcataattatttgctttcgatagaacggatcaggctggcgacttcatgttttttcaactcgtcctgcatttttttcaccgcatcggcagacatattgccgctttgcacccggtaaagcgttttatgtcccgcctgataaccgaccaccttggaagatatgcccaagattgccagtttggcacgctgcccttccgcgctctgacggtcggcatacgcgcccatttgcagataatgcgttgcttccgccttgtcggacgttttcattttctgcacttctttggcggcggcactgcgcgctttttcgatgctgccgctgttgaggatttgttccggggttggtttgggtgcaactttttccttcgccgcctttttctcttcttttgaagcttttttctctgtttctttagacggttttaccgcttgttttttaaccgtttcggcatctttcttctgcgctttttccctgacggtttgttcacgctcttccgtcagcgctttcttacgcactgcctgtccgtccggctcttcccgttccggctcgcccgccttttcttcaacctcgtcggctttatcggcaacgggctgcttgtcggcagctttttccgcatccgactgctctgcctctgtcgcagcatccggttcggacaaggcgttttgatcggccggttcaggttggatgtcttccttaggctggtttttcggtttcaggatttccgtttctgcaggctgcttcgacgaagccgggattttgaacgcattttgaccgctctggttcagataaaacaaaataccggcaataatgaccgtcgccagtatcaaaccgaagaaaaaaccggacagaccttttccggattgggaaaatttgttcataaacataccttaatgtgtttcagacggcattaacgccgtttgcttacgggcggatattctaacaatatcgccatatttgggcaaaacctgcttccattcccattcctataaagcacgacggaaacctatggctttcatgacgtggcttctgccgacttcttcgtcgcccgccaaatccgccaatgtacgcgccacgcgcataatgcggtggaagctgcgggcggaaagggagagtttttccagcaggccgcccaatgcttcctgcgcttctttttgaatgcgggcggatgtgtcgagttcactgacactcaaggcggcattcactttgccttgccgtgcgtattgtttgtctctagcggcgataacgcgttccaaaacggacgcgctgctttcccctgcttcctgctgcatcagttcggcggcggacaggctcgggacttcgatggtcaaatcgatgcggtcgagcagcggcccggaaatcttgctgcggtaacgcgcgacgctttcgggcgtgcagcggcagggtttgacgggatgcccgagataaccgcacgggcaggggttcatggcggcaacaagttggaatttggcaggatagacggcttggcgcgccgcgcgggaaatgtggatttcgccgttttccaacggttcgcgcaaaacttccaaaactttgcggtcaaactcgggcagctcgtccaaaaacaaaacgccgtggtgcgccaatgaaatttcgcccggacgcggatccgaaccgccgccgaccatagccgccgcgctggcgctgtgatgcggactgcggaaaggacggttgctgtcgagttgttgttggtggttgggcaggagcgaacgcaatgcccaaacttctaccaattcgtcttcggtcagcggcggcaggatgccgggcagccgttgggagagcatagacttgcccgttcccggcggacccatcatcaagaggctgtgtccgcctgcggcagcgatttccaaagcaaggcgcgcggtgtgctgacctttcacatcgcacaaatcaggttgtccgccatgttcaaacggcatctgaggaacttggcattcggtttgcgccaaaggttcgatgccgttcaaatgggcggcgacttcgcccaaagagcgcgcgccgtaaacggtaatgccgcgcatcacggcggcttgtcctgcattttcttcaggcaaaacaaatgcacgttttgcctgcataccctgccacgccatcgccaacgcgccacgcacggggcgcaacagccccgacagtgccaattcccccgcaaactcgtattcctccagtttttcgggcgcaacctgccccgatgcggcaaggatgccgattgcaatcggcaaatcgaaacgccccgactctttgggcaggtcggcgggggcgaggttgacggtaatttttttggcggggaattcaaaaccgctttgaataatggcggcacggacacggtcgcgactttcctttacttccatatcgggcagtccgacgatgttgaaatgtggcaggccgttggcaaggtgggcttccacttcgaccaacggcgcattcataccgctcaaggcgcggctgtaaaccaaggcaagcgacatatttcagacgaccttattcgccggcttcggtttgctgcctgatttcggcgacggcttcttcggcagcggcttcagccgcttccaatgctgcccgttcgggattttgcgcggcttcgagtttttccaaacgcgcttccaaagccgccagtttggtacgggttttgattaaaacctgctgctggatgtcgaattcttcgcgcgtaaccagatccatacggttgaacgcgccgcccagcatcgccttaatatttttttccacatctttggcagggctgttggcgatggtttcgctgattttcgagccgacttcctcaaaaagctgcttgccgaacataatctgtatccttcctgaacatatcaaattcaatcggctattgtataaggaaaaatgccgtctgaaaacgggcggcggataatcggcaaaacataccgcgcctcctttgcggttgctaaattacacctcaaaacaccccgcctgaaaacggatttcatattccgcgcaacgcccgattacaagacactacaaaacaatatgctgttttaaatgatttttccgacgcgcatcgtttcaaactcggctttttaagccattaagtgctttgcaaacaacagaaattgggttatcctgaaacggattatttacaatttcatatagttttattacatatcttattgtgattgaagataatttatccgaatccccctttcgggtatccggattttccgttgtacttttattagaaaaacatttcaggcgcaagttgcttgcaatttcaaagccg

SEQ ID NO: 37793 - DNA, 13786 bp, Neisseria meningitidis
gagtctgtcaatgaaaacgtcgtgcgcggacaatataccgccgccagaggcatgaacggctatcttgaagaaatcaacgttccgcaagacagctttaccgaaacctacgtcgccattaaagccgaaatcgaaaacgaacgctggaagggcgttcccttctacctgcgtaccggcaaacgcatggcgggcaaagtggcggaaatcgttttgaacttcaaagatttgaacagccatatttttgaaggcagccgcaccgcgcccaaccggctcgttatcgagttgcaaccatatgaatccgtgcgcctctatacgcagatgaaaaccccgggggcaggaaataaggtcgaaaccgtgccgctggcaaccgatttgggcaaagcattggaaggccgccgcgcggaagcttacgagcgcctgctgctggatgtgattaacggcaaactcgctttgtttaaccgccgcgacgaacttgaagccgcgtgggaatatgtgatgccgattttggaaaactggacaaataacaccacgccgccgcacggctacggcgcacactcgtgggggcctgaagccgcgcgcgaactattggcgcgcgacggacacaagtggcacgaagagcagtaatacaataatgcgttcagacggcatggggtttgaaatgccgtctgaacataagtaaagtagtatagtggattaacaaaaatcaggacaaggcgacgaagccgcagacagtacaaatagtacggcaaggcgaggcaacgctgtactggtttaaatttaatccactataaaaagcagtcccgatatttggtatcaaaagcataaacaactgttcggccgacatattgctcaacccgtttccataacggaatatgccgtctgaaataaaaaaaggacacaaatatgtttgtttggcacgaatacgaaaatgcggcagaagcggcgcagtctttggctgacgcagtggcggatgctttgcagggcgcactggacgagaagggcggtgcggtgttggcagtttccggcggacgttcgccgattgcatttttcaacgccctgtcgcaaaaagatttggattggaaaaacgtcggcatcaccttggcagatgaacgcatcgtgccgaccgtccacgccgacagcaataccggtttggtgcgcgaatacctgttgaagaacaaagcggaagcggcaatgtggattcctatggtggaagacggaaaaactgaaaccgaattacatcccgatgctgttgtcgattatgcactgaaacattacaaacagcccgatgttttggttttgggtatgggaaacgacgggcatacggcttcgattttcccgaaagctccgcagtttcagacggcaatcgacggttcggcaggtgtcgcgttggtgcataccacgcccgttaccgcgccgcacgagcgcgtcagtatgaccttggatgcgattgcccatacggggcatgtgtttttggcgatacggggcgaagagaaaaaagccgtgttcgaccaagccgcacaaggcgaaaaccgcgaatatccgatcaacctcgttttgaaccatcaaggagtgaactgccatgtcttctacgccgaataaacaagccggatatccccgactggtcgccgatatcggcgggacgaatgcacgctttgcgctggaaaccgcgccgcgcgtcattgaaaaagccgccgtgcttccgtgtaaagactacgatacggttaccgatgcggtgcgtgcctatctgaatcaaagcggtgcaacagccgtacggcacgcggcatttgccatcgccaacccgattttgggcgactgggtgcagatgaccaaccaccattgggcgttttccatcgaaaccacccgtcagactttggggctggacaccctcatccttttgaacgactttaccgcgcaggcattggcggtaacgcagacttcaagcaaagacctgatgcaggtaggcgggcaaaagcctgtcgaatttgcccccaaagccgttatcggccccggtaccggcctgggcgtgagcggattggtgcacagccacgcaggctgggtggctttggcgggcgagggcgggcataccagtttcccgccgtttgacgatatggaagtgctgatttggcagtacgccaaaaacaaatacggccatgtttccgccgaacgctttttgagcggcgcgggcttgagcttggtttacgaggctttggctgcaaaacagaaagccaaacccgccaaactgatgccgtctgaaatcacggaaaaggctttgagcggcgcgtcgcctttgtgccgtcagactttggacatcttctgcgccatgctcggcacggttgcttccaacctcgccctgacgctgggcgcgcgcggcggcgtgtacctgtgtggcggcattattccccgcgtgttggaatatttcaaaacttccccgttccgcagccgtttcgagaacaagggcaggtttgaagcatatcttgccgcgattcccgtgtatgtcgtcttgagcgagtttcccggaatttccggtgcggctgcggctcttgacaaccatttgagaaacgtttaaccacagcggctccttgcagcggggctgcattatcgaagggcatatcattatgttaagcaaaatcagcgaatcactggcaaacctttccggtgcggaacgcaaagtcgccgaatgtgcattggcggaacccaaatggttcgtccatgccgccgttgccgaaattgccgaacgtgcgtccgtcagccagccgaccgtcatccgattctgccgcagcttgggttataaagggctgcccgagttcaagctcgccttgtccgccagcatcggtcatgagggtatgccctatgtccacgaagaactcaacgccgacgacgatatggcaagcgtggtcgagaaagtgttgggcaatgccgccgcctcgctgttgggcgaacgccgcttcctgaaagagtcggagctggaaaacgccattgccacgctgatgcacgcccgtcgcgtcgagttttacggtgtcggcaattccggcattgtggcacaggacgcgcagcataaatttttccgtttcggcatgtccaccgtcgcctatgtcgatacgcacacgcagctgatggcggcatctgttttgagcgatcaggatgttttggttgccatttccaacacgggttcgtctatcgaacttttggatgcggtcagcatcgccaaagaaaacggcgcgtctgtcatcgcactgacccgcaacgattcgcctctggcgcaacttgccgactgcgtgttgagcgttgccacacaggaaaatgccgaactctacacgcccatggtttcccgcctcttgcagcttgccgtcatcgacattctcgccatcggacttgccctgcgcttgggcgatgctgccagcctgcaattgcagaaaagcaaaaaaagcatacacaacaagcacatcgattacgacaaagattgaccttcagacggcatcccacaaatgccgtctgaaatgccgaacaacggtcgtcggcggcttgcggcagtttccggcagccttttcatcccacaacaaaaaacctcattcaggagcatatagatgaaacaccttcacgacttacccgcatggtcgaaattgtggaatcactttgacgacagcaaaacattgcatatgcgcgaaatgttcgagcaagacccgcagcgtgcggaacgctactggctgcaagtcggcggactgacgctggactactccaaaaaccgcatcaacgacgaaaccatgtcgcttttgttcgagcttgcccgagaagcaggcgtgccggagcggatgcggcagatgttccacggcgaaaaaatcaataccaccgaaaaccgcgccgtcctgcatgtcgcccttcgcaaccgcaccaattcgccgattgtggttgacggtgaagatgtgatgcccaaagtcaaccgcgttttgcaacgtatgggcgaatttgcacacgaagtccgcagcggaagctggctgggctataccaaccaagtcattaccgacgttgtcaacatcggcatcggcggatcggatttgggtccgctgatgatgtgtaccgcgctcaaacctttcggtcatccgcgcctcaatatgcacttcgtctccaacgtggacggctcgcaactgcgcgacgtattgtccaaagtccaccccgaaaccacgttgttcatcatcgcctccaaaacatttaccacgcaggaaacgctgaccaacgcgctgaccgcgcgcgaatggtttttgaatcatgcgggcgacgaagaagccgttgccaaacacttcgccgccgtttccaccaatcaaaaagccgtcgccgaattcggcatcgacaccgccaatatgtttgaattttgggattgggtcggcggtcggtacagcctgtggtccgccatcggattgccgattatgctgtatctcggcgaagaaaacttcattgaaatgctcaacggcgcgcacctgatggaccaacacttcatcaacacaccgctcgagcgcaacctgcccgtcattctcgccctcatcggcatctggtatatcaactactacggcggcggcagccacgtcatcgcgccttacgaccaacatttgcaccgcctgcccaaattcatccagcagctcgatatggaaagtaacggcaaacaggttacgttggacggcaaagcagtcggacacgaaacctcgccgattatctggggcgaaacgggcattaacggccagcacgcctttttccaactgctgcaccaaggcacgcacattacccccatcgacctgattgcctcgcttgaaaaacgcagcaacctgcccggacaccacgaaatcctgcttgccaacgtcttcgcccaagcagaagcctttatgcgcggcaaaacccccgacgaagtccgcgccgaactcaaagcgcagggtatggatgaggtgcgcatcgaagagctggtcccgcacaaaaccttctccggcaaccgcccgaccaacctcattctcatggacaaggtcaacccgcgcaatatgggcagcctgattgccatgtacgaacacaaaaccttcgtacaaggcatcatttggggcatcaacagcttcgaccagtggggcgtggaactcggcaaacaactggctaaaaccattttgggcgaactgaccggcgaaaccgggccgcaaaagcacgacagttcgaccgaacgcctgatcaacctctacctgcagaccaaccgcaaataaaacctgcggaaaaatgccgtctgaacgccgaccgtttcaaacggcatttttatcgaacaggaaaaccgtcggtaaacttgcagagcgtgtgcaatcccgatatgatggtttgcataaatttaaacatatatgttccgcagctatggcactgattaaagagccgttggacaaagtgaaacaaaggaacgaagaacttgaagcggcagaagaagcggcggcgcaggaggcattgggtcgggagcaggaagccgcccgcgtatccgaatgggaagaacgctacaagctgtcgcgcagcgagttcgagcagttctggaaaggattgcctcaaaccgtacagaataagctgcaagcctcacagaaaacatggaaaagcgggatggataaaatctgtgccaacaatgcgaaagctgaaggtaaaacgccaaacggcataaaattcagcgaactggcatgcaaaacggcgaaaaccgaagcacgcttggaagagctgcacaaccgtaaaaaagcccttatcgacgaaatggccagggaagcggacaagaaagaactgtcaaagcggctctgaacagcgcggttcaggcactgcccgccgatattgccgaaaccgtcatgcccgagtaccgcaactgacaaaacggtttgaatgccaaatgcgccgacggcgacgaatacggcgtggcacaatctgactgccgtaccagagaaatcaatgcgaaaaccaaagaaatccaaggttatctgattgactgaaacttggatgcgggaatgtcggcggcttttgcgtttttgtcgtttttatagtgaattaaatttaaaccgatacagcgttggctcgccttagctcaaagagaacgattctctaaggtgctgaagcaccaagtgaatcggttccgtactatttgtactgtctgcggcttcgtcgccttgtcctgatttttgttaatccactatatctttttccacttatctgcgctttcactatttgccctttcaggctgcgggcatagggacggaacaggtagcggtcaaatcctgtttcatccaaataaacacgttggtagtcggaaaattcggccggctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatccgggtgttgcccaacatattgagccggtttttgcctatccgatttgacggcatttagaccggtaacttgatgttttaggctgcctgtttgttttttaaggcgaatccacaggtaaagcgtgtttcttgacaagttaaacgttgctgcggtttggctgatgtttttgcattgttcgtaatatagtggattaaatttaaaccagtacggtgttgcctcgccttgccgtactatttgtactgtctgcggcttcgtcgccttgtcctgatttaaatttaatccactatagtttaaagctttgtttcttaagtccgcagagtatgccatggttagaccttcaaagttgaatattgtactattttgtttttggggctgtcctagataactaggataaactcgattttactaattgttttaaaatggaaatttgaacttttatctcactgttgttaaaacgccgttcgtacccctttaaatacagctcaaaatgcgctttgggaatgccgtcaaacttgcgtaaatgacgttttgcccggttccaaaagttctcaattccattgatatggttttgtcgttcagcaaaataactttcatctgcttctacttcgccatcaaacatttccaaatgcggactgttttgataaataagtaatcgtaaacgatgaaaataataggctgcggtacttttattaacgcctactaactctgctgtcgttcttgcagttacacctgcgacaaacagttcaatgagtttatttgtttataccggcttagacgactttttctcataggggcaactctaacttaatttgaatttccctagttatctaggacagccccttgtttttaattgactataatccgctatattgtgagaagctggatgacggatgagggataaaataaatgccgtctgaatcttcagacggcatcgggagatgattttcagttctcgacttccggttcggttacattggaaattacagaagcgtcggagagttcggattcgtcttcggcaacacgttccagcgataccaaggtttcgccttcgtccaagttaatcagtttcacgcctgctgcggcgcggccggtttcgcggatttgttcgactttggtgcggataagtacgccgccgctggtaatcagcatcaaatcgtcggtttcgccgaccaaggttgcggcgaccaaatcgccgtttcgctcgccagtgttaatggcaatattgccttgcccgcctttgtttttgcggctgtaatcggcaatcggggtgcgttttccgtatccgttggcggtggcggttaaaacttgcaaaccgctttcttcggtttcaggggcgaaggtaatcaggctgacgattttgccgtcggcaggcaggcgcataccgcgcaaaccgccgctgccgcgaccggacgggcgaacaccgtgtttgccgctcggcagtgcgttttcgctgtcggcggtttcatcttcgatgccgtctgaaatttcggtttcgatgtcggcatcttccgcttcgtcgttgccggatttttcccagtattcgttgaagcggatggctttacctaagttggagaacagcatgatgtcgtccgcaccgcctgtttgcgcagcgccgacgaggtagtcgccttctttgagcgcgatggctttaatgccttgggcgcggacgtttttaaaggcggaaagttggacttttttcaccattccctgcgcggtggcgaagaagacgtattggtcttcggggaactcgcgtactgccagaatcgcgctgactttttcgccttcttccaactggatgacgttgttaatcggacggccgcggctgttgcgtccgccttcgggcagtttgtaaaccttaatccaatgacacttgcccaaattggtaaagcacatcaaataatcatgcgtgttggcaacaaacagggtttcgataaagtcttcgtctttggtggcagccgcctgtttgccgcgcccgccgcgacgctgcgcctgatagtcggtggtcggctgggttttgatatagccgccatgtgtcagggtaacgaccatttcgcgttgcggaatcaggtcttcatcggcaatgtcgccgccgaacgggttgatttcgctgcggcgttcgtcgccatagttggttttgatttcttccagttcgtcgcggatgatttgggtaatgcgttcgggtttggagaggatatccacaaagtcgatgattttacccatcaggtttttgtagctttcgacaatttcttcttgatcgaggccggtcaggtttcgcaggctcatgcgtaaaatagcatctgcctgaatctcgctcaggtaataaccttgctctttcaagccgatgtttgcagccaatccttccggacgcatcatttccaaatccagaccggaacgcgtcagcatttcttcaacgaggctgctgcgccaagggcgcgcaagcagtttgtctttggcctcggctgcgttgggcgattctttgatgagcttgatgatttcatcgatattggacagtgcgacggctttgccttcggcaatatgcccttcatggcgtgccttcttcagccggaaaagcgtacgtcgggtaacgacttcgcggcggtggcgcaggaattcggagagaatctgtttcaggttcaacaggcgcggttgtccgtcgaccaaaaccaccatattgatgccgaaactgtcttgcagcggagtcagtttgtagagttggtttaagacgacttcggcattttcgttgcgtttcagctcgataacgacgcgcataccggatttgtcggattcgtcgcggagctcggaaatgccttccagtgttttttcccgaaccaaatcgccgattttctcgaccagcttggctttgttgacctgataggggatttcgtcgataacgatggcttcgcgttcgccgtttctgcctatgggttcgatatgggtcttaccgcgcataacgacgcggccgcggcctgttttatagccttcgcgcacgccgctcaagccgtagatggttgccccggtcgggaagtcgggggcttggataatgtcgatcagttcgtcgatttcggtgtcgggtgcatcgagcaggcgcaggcaggcattgacggtatcagaaaggttgtgcggcgggatattggtcgccatgccgacggcgatgccggacgagccgttgacgagcagtgtggggaaacgggtcggcagtacaagcggctcgtgttcgctaccgtcgtagttcgggccgaaattgacggtttcttcctcaatgtctgccagcatttcgtgggaaattttcgccatgcggatttcggtgtagcgcatggctgcggcggcaagcccgtccaccgatccgaagttgccctgtccgtctatcagcacataacgcatagcgaaattttgcgccatacggacgatggtgtcgtatacggcggtatcgccgtgggggtggtatttaccgatgacgtcgccgacaatgcgcgccgattttttgtaggcggcattccagttgtttttcagctcgtgcatcgcgtacagtacgcggcggtgtaccggcttgagaccgtcgcgaacgtccggcagcgcgcgcccgacaatgacgctcatggcgtagtcgagatagcttttgcgcatttcgtcttcaaggcttaccggcagggtttcgagggcgaatttgtggtcgtggcggatggttgcgtcggtcatggtttcaatgtttcgtatggcaaaaaattgttgcttattttagcatattttgacgcggaacggtgcggcggttacgccgtctgaaacacggtgcggattataatgccgaggaaatttcgttgcggagtttgtcgagaaacctgccttggcggacttgttgtgcggctgtgtcgtaatcttgtcgggcaaacgactgtttcagaccgcagaacagtttttcttgttcgtcgcggatttcgttgtcgagatttttcaaggattcaaggtcgttgcctgcccgtgcctccatcagcgtttcgcgccattccatttgctgcataaggaattcgggggcgaaagcggtatgctccggcgcgtcggcatcgatgcccgatgttttcagcaggtaggcggcgcggtcgatggggtttttcaaggtgcggtaggcatcgttgatggtggaagacatcatcactgcctgcttttgctcaaaggcggaagctgaagcgaatttatcgggatggaaacgggcggccaaggcgcggtaggtttgttccaagttttcggtgtcgatatcgaaagcgggttcaatccggaagagggtgaaatattgggacatagtaggatgataaatgtaagattttggcagaaaactgtttttgccttataatctgccgcttcttaaacgaaaggactgaatatgggcggcaaagtgcagcacaataaaggcaaaatacgcgacaatgctttaaaagccttagtgaaatccgatttgttccggcacaaggtggaacggaaaaggaaaggcaaaggcagctacaacaggcaggaagcgaaaaaatggcgggacggttttgatacggtcccgccgtttttatgccttaaacgtggaagctttcgccgcagccgcaggagtctttgacattggggttttcaaatttgaaaccttcctgcaaaccttctttggtgtaatcgacttgcgtgccatccagataaaccaggcttttcggatcgatataaatgcgcgcgccgtgtccttcgaaaatcaggtcgtcgccatcggcttcgtcgacaaattcaaggttgtacgccatccccgagcagccgctggttttcacacccaagcgtacgcccaagcctttgccgcgtttggcgagatagtcattgatgtgttttgcggcattctcggtaagggtaatcatatttcttccttgttgtaccgccccggacggacctgaagcggcgggtggttcggacggcattgcgggatgatgccgtctgaagggctttatctgttttcctgacgtttgcggtagtcggcaacggccgcttttaccgcatcttcagccaagatggagcagtggatttttaccggcggcaattccaactcctcggcgatttcgctgtttttgattgccagcgcgtcatccaggcttttgcctttaacccactcggtaatcaggctggacgaagcgatggccgagccgcagccgtaagttttaaatttcgcatcttcgatgatgccctcgtcgttcactttgatttgcaggcgcatgacgtcgccgcaggcgggcgcgccgaccatgccggtgccgacggaatcgtctcccttgtcgaatgtgccgacgttgcgcggattttcatagtggtcgattactttatcgctgtatgccatgatgtggtttccttaatgttttttgatggtttaagtggtttgtttgccgattttcagacggcctgaagtttagattttgcacgccccgccttcgcagccgtcgtcgttttccgaatcgacgccgccttccacggtaacgccgtcaaaatcttcaagcaggttgtcgagattgtccaaatctaaatcttgttcgttcatattttctcttgattgctttgtttttggaatgccgtctaaaggttcggacggcatgttggtacgctttaatgcgctgcccattcaatcgagttcaaatcaatcccgtctttgaacatttcccacagcggcgacagttcgcgcagtttgccgattttggatttaatcagttcggcggcgaattgcacttcttcttcggtggtcatgcgaccgaaggtgatgcgcagggatgagtgcgccagttcatcgttgcggccgagcgcgcgcaggacgtagctgggttcgagcgaggcggaggtgcaggcggagccgctggatacggcgagttctttcactgccataatcaggctttcgccttcgacgaagttgaagctgacgtttaggttgttcgggacgcgatgttcgaggtcgccgttgatatagacttcttcgatgccttcgatacctttgaggaaaatatcgcgcagtttcaggtagtgtgcagtgtcttgtgccaattcttctttggcaatgcggaaggcttcacccatgccgacgatttgatgggtcggcaatgtgccggaacggaaaccgcgttcgtgaccgccgccgtgcatttgggcttcgaggcggacgcgtggtttacggcgtacatacagggcgccgatgcctttagggccgtatactttgtggccggacatagacagcaaatcaacttttgcggcttcaacatcaacaggcactttgccgcatgcttgtgctgcgtcaacgtggaaaatgattttgcgttcgcggcagatttcgccgatggcaggaatatcttgaaccacgccgatttcgttgtttacccacattacggaaacgaggatggtgtcttcgcggatggcggctttcagtacgtctaaatcaaccaaaccgttttcttgtacgtccagataagttacttcgtaaccttggcgttcgagttcgcgcatggtgtcgagtacggctttgtgttcggtttttacagtgatgaggtgattacctttagatttgtagaagtgcgccgcgcctttgatagcgaggttgttggactcggttgcgccgctggtgaaaacgatttctttagagtcggcgttaatcagggcggcaatgtctgcacgtgctttttctacagcttcttctgcttcccagccgaagctgtggctgttggaggctgggttgccgaaggtttcggtcagatagggaatcattttttcggcaacgcgtttgtcaacggggggggtggcggcgtagtcgaggtaaacgggggttttgacggtcatggtttgctctttctttttcgggtgttatttaatggatgtgtgtaaattggacgacgcggctgccgtcgccgttgtttttctgttcgatgatgctttgcagggtaacgctgccgaggtagtcgttgatggttttgtttaaattctcccaaagatcgtgcgtcaggcagggcgcgccgtggtggcagttggctttgctgccgcattgggttgcgtccagccggtcttcggcggcggcgatgatttgggcgatgttgatgcgtgccgccggtgcggcgaggatgtagccgccgccgggcccgcgcaggctttcaacaagtccggcgcggcggagtttgccgaacaattgctcgagataggagagggatatgttttggcgttcgctgatggcactgagtttgacggcgccggtttgcgcgttcatcgccaaatccagcatagcggtaacggcgaaacgccctttggtggtcagtctcatggtggtggttgcccatgtcggtttttttagg

SEQ ID NO: 37794 - DNA, 34827 bp, Neisseria meningitidis
gaagactttgattctttttttcagcatatgaaggaatatcaatatgctattgacaatgaagacattaaatctgcatgtagttcactatgtgaagctatgctctatgttggtaatattaaaaatttttttgagtttctcaaaagcgatatgattagactgttgagaggtgaaagtaaaacaacagactttcaatggccgcaatttgatgaatagcagcaagctgtagcctgcatgaaacctaaaatccatgcgtaaggtgtgtgcttcagcacgcacgcgttccatgatttacggctcaatgccgtctgaaaagctcacaatttttcagacggcatttgttatgcaagtaaatattcagattccctatatactgcccagatgcgtgcgtgctgaagacaccccctacgcttgctatttgaaacagctccaagtcaccaaagacgtcaactggaaccaggtacaactggcgtacgacaaatgggactataaacaggaaggcttaaccggagccggagcagcgattattgcgctggctgttaccgtggttactgcgggcgcgggagccggagccgcactgggcttaaacggcgcggccgcagcggcaaccgatgccgcattcgcctcgctggccagccaggcttccgtatcgctcatcaacaacaaaggcaatatcggtaacaccctgaaagagctgggcagaagcagcacggtgaaaaatctgatggttgccgtcgctaccgcaggcgtagccgacaaaatcggtgcttcggcactgaacaatgtcagcgataagcagtggatcaacaacctgaccgtcaacctggccaatgcgggcagtgccgcactgattaataccgctgtcaacggcggcagcctgaaagacaatctggaagcgaatatccttgcggctttggtgaatactgcgcatggagaagcagccagtaaaatcaaacagttggatcagcactacattacccacaagattgcccatgccatagcgggctgtgcggctgcggcggcgaataagggcaagtgtcaggatggcgcgataggagcggcggtcggtgaaatcctcggcgaagccctgctggacggcagagacccgggcagcctgaatgtgaaagaccgggcaaaaatcattgctaaggcgaagctggcagcagggacggttgcggcgttgagtaagggggatgtgaatgctgcggcgaatgcggctgctgtggcggtagagagtaatgcgcttagcaaggaaagaatggataaattgacaaaatgcctttccggtaaaacttgttctactacgatggaaaaagtaaatgccatcaaaaaggatgaacaatttagcaaagtaattgatacggaaattcaaaaagtctgttctaggaacccattgggcgatggttgcagaaacggcattaatatgtctattaaatatattgccatgcctgctgcgtggaagtatatgcctacggatgtatcacgggttgccaaagaagtttttggctatttatataactcacaaggggcatctacaagatttgacaagtatttcaacaccattgacaatcgtgcagatttctttgctgccagcaatctttatgagcaaaatttgggttcaaaagcacgatggtttggtggagctgattttgtatcgcgtgctgctataactgggttaggggcagacggagaagcttcttatataacttttgcggcaggtaaagttgttggtaatcctccaatttatgaatggagggctgcgtcaggcaatgcactgatagtaaatggattttataattttagagacttgttcaataaaaaaactaatcctagggagtgggatattcaacagttgaaaagcgagcaaaagttattacagcctattcaccaaaaatatttgagtaatgagaaggattatttgtcattgattaaaggggtaacatcaaataagatattttcaataattccaaatcctttagatgagaggaaaaaaatagaggatggaattaatatgttagattacaaatctagaattaaatatggttgtaagcttatgggatattctgagaaacagggatgcaagccatgaataaaaattatttattttatcttattcaaaatattaaatctattttcttaataggtggagtattttttggccttttaattttttcaggtttatggggtaatgattttaaactatcttttttaggggtaatagattttatatttgggatggtagggggtgggtttatagttatgttatggtttctaattccagtgatattatcaactttattcagatgggtatttcaaaatcaacttgctgtatctgtcatattaaccttcattgttttttatacatatgggtacttttctttatttaattcatctgaaagagtcggtagtttttggtatttggtaatcccaaccataatgtttattggactgtctgaatggtttatctataaatctagcgtgcatagtttaggtgaaaatgtaactccacgttccaattgaagaaaaagattgtctgaaaactaaatttaatttcagatgaccttagattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatccggtggtgtttgcacaggtaggcgcatacttgttcgggactgagtttgcggcggataagggtgtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccaccgtccaaaatgctctttgggaatgctattggattatagaccttacaacagaaaaaaaggtcggaaagtagaaagactgctttttaaattcaaacggccaagcaagtaaagacttggccaacaaatgggacaaaatccgactgttttaaattgccagtcaaatactggaaaacttgcgtaaatggctaaattcactgacatcaagtacatcataactacgaaaggtatccgtatacacaatgccatcagacttaactttctctcggataatcggcaataatgttgctgattgcgcattagggacaacgacggtataaaccttgccatttcgttcgaatgggatttttaaccgttatctagtaaagtccctaatttaataaacaaatggcagtaaaatggcggtaattgactcgccaaaatccttgatctagaatggtcagactatccaattttttctaataactctataaaaatcaaataactgaaatcatgaataaaactctctatcgtgtaattttcaaccgcaaacgtggggctgtggtagccgttgctgaaactaccaagcgcgaaggtaaaagctgtgccgatagtgattcaggcagcgctcatgtgaaatctgttccttttggtactactcatgcacctgtttgtcgttcaaatatcttttctttttctttattgggcttttctttatgtttggctgtaggtacggccaatattgcttttgctgatggcattattgctgataaagctgctcctaaaactcaacaagccacgattctgcaaacaggtaacggcataccgcaagtcaatattcaaacccctacttcggcaggggtttctgttaatcaatacgcccagtttgatgtgggtaatcgcggggcgattttaaacaacagccgcagcaacacccaaacacagctaggcggttggattcaaggtaatccttggttggcaaggggcgaagcacgtgtggttgtaaaccaaatcaacagcagccattcttcacaaatgaatggctatattgaagtgggcggacgacgtgcagaagtcgttattgccaatccggcagggattgcagtcaatggtggtggttttatcaatgcttcccgtgccactttgacgacaggccaaccgcaatatcaagcaggagaccttagcggctttaagataaggcaaggcaatgttgtaatcgccggacacggtttggatgcccgtgataccgatttcacacgtattctcagttatcattccaaaattgatgcacccgtatggggacaagatgttcgtgtcgtcgcgggacaaaacgatgtggtcgcaacaggtaatgcacattcgcctattctcaataatgctgctgccaatacgtcaaacaatacagccaacaacggcacacatatccctttatttgcgattgatacaggcaaattaggaggtatgtatgccaacaaaatcaccttgatcagtacggccgagcaagcaggcattcgtaatcaagggcagttgtttgcttcttccggtaatgtggcgattgatgcaaatggccgtttagtcaatagtggcacgatggctgccgccaatgcgaaagatacggataatacagcggaacacaaagtcaatatccgcagtcagggcgttgaaaacagcggtacggcggtatcgcaacaaggcactcaaattcacagtcagtcgattcaaaacactggcacattattgtcctcaggcgaaatattgattcacaattcgggcagcctgaaaaatgaaacatcaggcaccattgaagccgctcgtttggctattgataccgacacacttaataatcaaggcaaactctctcaaacaggttcacaaaaactccatattgatgcacaaggcaaaatggataaccgtggccgcatgggtttacaagataccgcaccaaccgcgtcaaatggttcaagcaatcaaaccggcaatagttacaatgcatctttccattcatccactaccacaccaacaacggcaacaggtacgggtactgcaaccgtttctatatcaaacataactgcgcctacctttgctgatgggacaattcgcactcatggtgcactggataattcaggcagtattattgccaatggtcaaacagatgttagtgcgcaacaaggtttaaataatgcaggacaaatagacattcatcagttaaatgcaaaaggttcggcgtttgacaatcacaatggaacaattatcagtgatgcggtccacattcaagccggcagcctgaataatcaaaatggcaacatcacaacacgccaacagttagagattgaaaccgatcaactggataacgctcatggcaagttattatcagcagaaatagcggatttagccgtttcaggcagcctgaacaatcaaaatggcgaaatagcgaccaatcaacaactgattattcacgatggtcagcaatctaccgctgtcattgataatacgaatggcacgatacaatcaggccgtgatgttgctattcaggcaaaatcgttatccaacaacggcacacttgccgctgataataaactggatattgcgttacaagatgatttttatgtagaacgcaatatcgtggcgggcaatgaattgtcgctcagtacacgaggcagcctgaaaaattcacatactttgcaagcaggaaaacgcattcggattaaagcaaataaccttgataatgcagcacaaggcaacattcaatccggcggtacgacagacattggcacgcagcacaatttaaccaatagaggcttgattgacggacaacaaaccaaaatccaagccgggcaaatgaataatatcggtacaggtcggatttatggcgacaatatcgctattgcggctacccgcttagacaatcaagatgaaaacggtacaggtgccgccattgcggcacgtgaaaacctgaatttaggcatcggacaattaaacaaccgtgaaaacagtctgatttacagcggtaacgatatggcggttggcggcgcattagataccaatggccaagccacaggcaaagcccaaaggatacacaatgccggcgcaaccattgaagctgcaggcaaaatgcgtttaggtgtagaaaagctgcacaataccaatgagcatttgaaaacgcagttggtagaaacagggcgcgagcatattgttgattacgaagcatttggacgacacgaattattgcgagaaggcacgcaacatgaattaggctggtctgtctataacgatgaatcagaccacttacgcacccctgatggagcggcgcatgaaaattggcataaatacgattatgaaaaagtcacccaaaaaacccaagttacccaaactgcgccagccaaaatcatttcaggtaatgatttaaccattgatggtaaagaagtatttaataccgatagccaaatcattgctggtggcaatctcattgtacaaacagaaaaagacggtttgcataacgagcaaacctttggcgaaaagaaagtattcagtgaaaatggcaaattacacagctattggcgtgagaaacataaaggacgagactcaacgggacatagcgaacaaaattacactttgccggaggaaatcacacgcaacatttcactgggttcatttgcctatgaatcgcatcgcaaagcattaagccatcatgcgcccagccaaggcactgagttgccgcaaagcaacggtatttcgctaccctatacgtccaattcttttaccccattacccagcagcagcttatacattatcaatcctgtcaataaaggctatcttgttgaaaccgatccacgctttgccaactaccgtcaatggttgggtagtgactatatgctggacagcctcaaactagacccaaacaatttacataaacgtttgggtgatggttattacgagcaacgtttaatcaatgaacaaatcgcagagctgacagggcatcgtcgtttagacggttatcaaaacgacgaagaacaatttaaagccttaatggataatggcgcgactgcggcacgttcgatgaatctcagcgttggcattgcattaagtgccgagcaagtagcgcaactgaccagcgatattgtttggttggtacaaaaagaagttaagcttcctgatggcggcacacaaaccgtattggtgccacaggtttatgtacgcgttaaaaatggcgacatagacggtaaaggtgcattgttgtcaggcagcaatacacaaatcaatgtttcaggcagcctgaaaaactcaggcacgattgcagggcgcaatgcgcttattatcaataccgatacgctagacaatatcggtgggcgtattcatgcgcaaaaatcagcggttacggccacacaagacatcaataatattggcggcatgctttctgccgaacagacattattgctcaacgcaggcaacaacatcaacagccaaagcaccaccgccagcagtcaaaatacacaaggcagcagcacctacctagaccgaatggcaggtatttatatcacaggcaaagaaaaaggtgttttagcagcgcaggcaggaaaagacatcaacatcattgccggtcaaatcagcaatcaatcagagcaagggcaaacccggctgcaagcagggcgcgacattaacctagatacggtacaaaccagcaaacatcaagcaacccattttgatgccgataaccatgttattcgcggttcaacgaacgaagtcggcagcagcattcaaacaaaaggcgatgttaccctattgtcagggaataacctcaatgccaaagctgccgaagtcagcagcgcaaacggtacactcgctgtgtctgccaaaaatgacatcaacatcagcgcaggcatcaacacgacccatgttgatgatgcgtccaaacacacaggcagaagcggtggtggcaataaattagtcattaccgataaagcccaaagtcatcacgaaaccgcccaaagcagcacctttgaaggcaagcaagttgtattgcaggcaggaaacgatgccaacatccttggcagcaatgttatttccgataatggcacccagattcaagcaggcaatcatgttcgcattggtacaacccaaactcaaagccaaagcgaaacctatcatcaaacccagaaatcaggattgatgagtgcaggtatcggcttcactattggcagcaagacaaacacacaagaaaaccaatcccaaagcaacgaacatacaggcagtaccgtaggcagcttgaaaggcgataccaccattgttgcaggcaaacactacgaacaaatcggcagtaccgtttccagcccggaaggcaacaataccatctatgcccaaagcatagacattcaagcggcacacaacaaattaaacagtaataccacccaaacctatgaacaaaaaggcctaacggtggcattcagttcgcccgttaccgatttggcacaacaagcgattgccgtagcacaaagcagcaaacaagtcggacaaagcaaaaacgaccgcgttaatgccatggcggctgccaatgcaggctggcaagcctatcaaacaggtaagagtgcacaaaacttagccaatggtacaaccaatgccaaacaagtcagcatctccataacctacggcgaacagcaaaaccgacaaaccacccaagttcaagccaatcaagcccaagcgagtcaaattcaagcaggtggtaaaaccacattaatcgccacaggcgcagcagaacaatccaatatcaacatcgcaggctcagatgttgccggcaaagcaggcacaatcctgattgccgataacgacatcacactccaatcagccgagcaaagcaataccgaacgcggccaaaacaaatcggcaggctggaacgcaggtgctgccgtatcattcggacaaggaggctggtcattaggcgttaccgcaggcggcaatgtcggcaaaggctacggcaatggcgacagcatcacccaccgccatagccatatcggcgacaaaggcagccaaacccttatccaaagcggtggcgacactaccatcaaaggcgcgcaagtacgcggcaaaggcgtacaagtcaatgccaaaaacctaagtattcaaagcgtacaagatagagaaacctatcaaagcaaacaacaaaacgccagtgcacaagttaccgtaggttatggcttcagtgccggtggcgattacagccaaagcaaaatccgagccgaccatgtttcagtaaccgagcaaagcggtatttatgccggagaagacggctatcaaatcaaggtcggaaaccatacagacctcaaaggcggcatcatcaccagtacccaaagcgcagaagacaagggtaaaaaccgctttcagacggccaccctcacccatagcgacatcaaaaaccacagccaatacaaaggcgaaagttttggattgggcgcaagtgcgtccataagcggcaaaacactgggacagggcgcacaaaataaacctcaaaacaaacacctgacaagcgtagccgataaaaacagcgcaagttcatcagtgggttatggcagcgacagcgacagtcaaagcagcatcacaaaaagcggcatcaacacccgcaacattcaaatcaccgacgaagccgcacaaatccggctgacaggcaaaacagcggcacaaaccaaagccgatattgatacaaacgtaaccacagacaccgccgaacgacattcgggcagcttgaagaacaccttcaacaaagaagcggtgcaaagtgaactggatttacaaagaaccgtcagccaagattttagtaaaaatgttcaacaagccaataccgagattaaccaacatttagacaaactcaaagcagacaaagaagcagccgaaacagcagcagccgaggcattagccaatggcgatatggaaactgccaaacgcaaagcccatgaagctcaagatgcggcagcaaaagcagataattggcaacaaggcaaagtcattctcaacatgttagcctcaggtttagctgcgccgacccaaagcggagcgggcatcgctgcggctaccgcatcgccagccgtatcgtatgcgattggacagcactttaaagatttagccggtcaaaacgcgaatggtaaactaaccgccagtcaagaaaccgcacacgttcttgcccacgcggtattaggagcagcggttgccgcagtaggagacaacaatgctctagcaggagcattgagtgcgggcgggtcggaagcggctgcgccttacatcagcaaatggttatacggcaaagaaaaaggaagcgacttaacggcggaagagaaagagactgtaacagcgattacaaatgtattgggtacggctacgggtgcggcagtcggcaacagcgcaacagatgcagcgcaaggcagcctgaatgcgcaaagtgcggtggagaataatgatactgtagagcaagtgaaatttgctcttaggcaccctagaattgctattgcaattggatctgtacataaagatcctggctctacattagagcctaatatttcaacaattgcttcaacttttcaattaaatttatttcctaatagtgaatttggtggtgaaggtggagttggcaatgcattcaggcacgttttatggcaagcaaccatcacacgagaatttggcaaagatattgctgttaaagtaggaaatagtcatgaaagtggggaaaaaattaattattctataagacgtaatctttcattagataaagcagatgaaatgattgatcaactaaataacgaaataggaagagaaatagcattaaataccaataggttaaacacaaaagagttagttggattaattctggaaacttataaaaataatggtttttatcaagcagaaagaaacagtaatggaaattatgatgttgtaagaaaaagattatctgaaaaagattaccagaatacaagcaatatattgattcacttagataatactggtgccggatttaaaattcagcagaggagaaaacaaatcagagcacaaatttcagccagacaatggagaagataaaagatgaataaaaatatactttatatattttctttattaatcactattgttattttctttatatttgaaaagaatgtaataagaaaaataagttttaattataataaaaaagaattcttaattagtgatataacgaattttaattgggattatgtaaaactgtatataatcaattcagatttccaaaaaattgttttttatcataaaagtaagatagtttttgaggaattaatagaactagataaggaagggaatgttttacctcaatatctatttgattcagatttgaaaaatgttgaatattacgaatgtgattacaagaatggcaagatgcaacttttaaaaaaagaaaaatcacatttttttgatggatatttttattattataaacctataaattgtaggccgaaacttttgtaaaactatccttcgtcattaccgcctaggattcaggattaggactcgtttggggagcagggagttctgatatggcttggagtatgtttgccacaacccaagccgatagagcggtaaggtctgcaactgcacctaaagaaatgtggttccataagaagataatagatgaaaaaacaggtaaagtatcctttgataccagacaaatttggtcattgaatgatttaagcaaggaagaactggcaagcattcaagacacaaatggcaaagttattactgtgtctaatcctggtattttcaataatcgagaagattcattaagcaacgcagcaaaacaaaatcgtaatagtacaaacggtagtggtgttattgcagtcatgaatcctccaacagggaaatataaatctgattctaataacaaaataaaagattttttatggctcggttcaagtcttgtttctgaactgatgtatgtcggttacgaccaattaaataataaagtgttccaaggctatttacccaaaaccaattcagaaaaactgaatcaagatatttatcgagaggttcaaaaaatgggtaacggctggtcggttgataccagtaatcacagtcgtgggggaattacagcaagcgtttccttaaaagattgggtaaacaatcaaaaacaaaatggcattgccccaatcagaaaagcacgtttctatggtacagccacaaatgtgcagaatgattacgccgatgttttacagaaaaacggctatacctatacgggtgcagacggcaaaacttataacagcggatcctactcaatcgtgcatgataaagattttgtggggaacaaatggatacctttcttgctaggaaccaatgacaccacacaaggtacatgtaaggggttgtgctattcgcatagcagttattttgcggaggtgccaaaagcaggtacaaaagaatttgatgactatgtaaaaatatggggtgaagttgaatatgacgctcaaggtaagccaattaacaaatctaaacccatactggtagaaccaaacaaaacaaaagataatgaaaaatatgaaaaagaagctttctaaatattctctgtttctttcatctgttttttgtctaacagcttgcgctactaccttattaggtactgtcgtagtcggtacagccttgtacggtactagtagtaactggacaactactgataaggaacaccaagaaattatgaattgccttgataaggcattagtaaaactgaatatctattttgagaatgatgaagaaaagtacaaaaacaaaacagtaatggatatttactatcagtgcattaaaaatcctaattatgttgtaacacacaataacttataaaggagagagatatgaagaaaaccctttctaatttagtgctaatatcattctgctcaacaatgctaacagcttgccctttttggggtagttgtgcagactggaattgctccaaacttaatccacgctgggagaaagccgttgacacatgtgaaactgaaaatctcacctttgttttgcatgaattaggcaatcaattaggatataaatctattaccgaagtctcatttagtgaaattgggcaacatatttcttatcagtgtattcaccatggcggtggatacaatattcgtaaagataagcagtatggtcatttgtttgtgcaataaccagcgtagcctgtgcaattaatgcgaactgttacatggtagggtgggcaactcgttgcccacgcagttcagtctcatgtgctaaaactatgttttaacgtgaaatatttcatttcaggctgaaaccattttttgttttaaccaacacgaaccctaacttaaaatatgcccatcactccacccttaaacatcatctctcctaaactctaccccaatgaacaatggaacgaaagcgaagcactcggtgccatcacttggctatggtatcagtcgcctacgcatcgccaagtacctattgtggagatgatgacgtatatattgcctgtgttaaaaaacgggcagttcgctttgttttgcaagggtacccaaccaatcggttatatctcatgggcttattttgatgaagtggcgcaggcgcattatttagaatctgaccgccatttgcgtgacaacagcgattggaactgtggcgacaatatttggctgattcaatggtttgcgccattgggacacagtcatcaaatgcgctcagctgtgcgccagttatttcctagtacgacagtacgcgccttgtatcataaagggagcgataagggtttgagaattttaacttttaaaacttgatgcaatcgtgtattgaatgcccattgatgattttattgattttgcgaccatgccatgaaacttcctttatcctatttgcctaatattcgctttttgtcttggtgctgcttattggcaggtatcattgctcctgctactttgttggcctcccccaaccctgccgaaatccgtatgcagcaagatattcagcaacgccaacgcgaagagcagttgcgccaaaccatgcagcctgaaagcgatgtgcgtttgcatcaaaaaaacacgggggaaacggttaatcagttgatgggcgatgacagcagccaaccgtgttttgccattaacgaagtggtgttggaaggcgaacaccatgctcggtttcagtttgccctaaaacgtgccttgcgcgaaacgggttttcaggctggcaagtgtctgcatgcgggcaacattaatcaaatcatgtccttagcacaaaatgctttgatcggcaggggatataccacgacccgtatcttggctgcgccacaggatttgaatagtggcaagcttcaattaaccctgataccgagctatctgcgctccatacgaatcgatcggtctaacgatgatcaaacccatgcaggacgtattgcagcattccagaacaaatttcccacccgctcgaacgatctgttgaatctgcgtgatttggaacaaggactggaaaatctcaaacgtctcccgactgcggaagccgatctccaaatcgttcccgtagagggagaaccaaaccaaagtgatgtcgtggtgcaatggcggcaacgtctgctgccctaccgtgtgagtgtggggatggataattcgggtagtgaggcgacaggaaaataccaaggaaatatcactttctctgccgacaatcctttgggactgagtgatatgttctatgtaaattatggacgttcgattggcggtacgcccgatgaggaaagttttgacggccatcgcaaagaaggcggatcaaacaattacgccgtacattattcagcccctttcggtaaatggacatgggcattcaatcacaatggctaccgttaccatcaggcagtttccggattatcggaagtctatgactataatggaaaaagttacaatactgatttcggcttcaaccgcctgttgtatcgtgatgccaaacgcaaaacctatctcggtgtaaaactgtggatgagggaaacaaaaagttacattgatgatgccgaactgactgtacaacggcgtaaaactgcgggttggttggcagaactttcccacaaagaatatatcggtcgcagtacggcagattttaagttgaaatataaacgcggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgtctgccgagcggggatggtattggcgcaacgatttgagctggcaatttaaaccaggccatcagctttatcttggggctgatgtaggacatgtttcaggacaatccgccaaatggttatcgggccaaactctagtcggcacagcaattgggatacgcgggcagataaagcttggcggcaacctgcattacgatatatttaccggccgcgcattgaaaaagcccgaatttttccaatcaaggaaatgggcaagcggttttcaggtaggctatacgttttaaaacggcatagtcaaatcaacggtaactatagatatagcttttcataataaaacacctatcatgattatggtaagagatggctgtgttttgatattagattgacacaggaatttaagaaggaatcatgaaatacatgattccttctcgtttgcctacattaaacatataggccgccaactcaatcaatagagtgatttaccagttttccaatcttcccagtatatctcctaccgaatacgattcttctaatttctcggtttcaaacaccataagatgaagtgattttcagggtgaaagtagaccggccatctctgacagcggcagctaccggaatgtaaacggtagaccttcttcattttcatccgggataaaatgccacttctgcgccaaccattcattctcacgcaatacatccgagtatttaacaagaacctgttctttagcttgaacgattgtatctatcataaaggatgcatcttctcttcccaaatcgcaatatttctcagcaaaatccaacaatgtattcttggaaggatatgttttcttaccgtggttagtcaggtttaatgccagcgtatcgtcataagcatcaaaaattccttgtgttccaaccctgtatattgatgtatccaatacatcatagacaggtgcaagacgaacatcgtattcgtcatgatagagtactgaaaaatttttgaggtgtgcatcgccgtttttcaatatgcaactggcagcaagctgattaaagaaatggattaaatcttcatctggtctgccggatatctgtcggataatctgtgcaatagccgcataactgcctttatatttatcttctaccgaatactggcgcagactggtaaagtcttccatccctaaaaaataaccctgttcactgacatcaaaccgacgtaccaataagactgatgaatcttccgacaggctggtctgtgcaacggcaatgccggcttgtttgatggtctgcatgcataaaaattcattggcagccaagcaaggatattcggatgcatcaaaacctttggcaatatatgaggcagtttgcttggtatttctgcggatggcatctaaggacatcttctgctgtatcccggatacactgacgaaacggccgtgatggaagatttctgccatatattgctgaaaaacctgtcgggcatttatgcccagcaaatcccgttcagtcaatattcttggatttttcatctccaacccgtcaatccattcattaaaaagcgggtcattacagcgcacatgtatccgacccaaagtctctctgcacagaattgccaagcgcagcatctcattgtcttcaaaaggcgcatcatgaaaagcatatttgcttgtgatgtgtgcatccaaaaagccttccggaaaatactgtgcaaagatatgcggcatattgttgctgatatataccttgcttctgtcttgataatgcaggcccagcaacgaagaattgggattgtcgtatgcgaaccgatacatggcccccttttccaaagtaccgattctttcatcgtttgcccaaacatccaaataggtgattctgggtttacgcatacgatttccggatacggtgaggatagacttcatcatgaaaaattctttcaaacgggaacagcggtacgtttagacacatctgctgatttaattgtacatggcgtattgcggatgaaattcagtaataccgcttctcgtgccttttatctcgttcggttagcattacattattgggtttttgcgtttccatagctgtaaattctcccattcttgagtattcaagtgcggttcgatttggttaagtaagtcataaactgattgcttgtcttcatcgcttggaaaccaatcatctaaaatcacccgaccgattgagccagtttgtaacactgctgtgtaaagataatccacgcaagcacgggggtgatctgcgagccaaactgggatgttttcagggaaataacccattttgttcagtcgatccgtcccatcaataatgccattatcaccaaataaatgattggtatttcgctcttgattttcaccgtaaatataaaatttttcagggtaagcccgatcactcaatgcctttgcactatgccagtcgcctgtaccgttaggactatgcacgtttaaggctacaatactgctaacatatcgaacaggttccgttggggggtatatgtaacataaagattccttaaaatttagcagagcaaaagtggtttccacgttttaggacatattttacaggatagtcaccccaataatgtaaggctgtgttttagtaatctgttgatttcaattacttgcaagggaaaagacaattattttccggttaggaataaacctatcctgttgaataccttaaagccaaacacgcctatcaacatcatattaaaacacagccaataattaaaagtatcgaattttctaaccctgcttgcttggaaagcaaaattgctacaatcttggttaaatcagctacaaagatcatttgtagagcaaaaagcaagcagtccgcagcttctttttgaaggtgcggactgtattgattttgactcggttaaagctgcattctgggctagcaaactattttttttctaacctttccaataaatcctgaggagcaacatactctaaagcatttcctgatttgaacggcactaggaatctatattctcccagtttactcaaatcgctacgggcagtattcagggagatgccgtattggttggcaatttcttgtgcagtaaagatttttccgctttcttccactgctttttgcaggataccaatttgccgttggttcaactttcctatcttttcagtatattgggcaatcgctgctttgaattcctgttggtgtttttgtttgtcggaaatgtagtgctccaaatcggcaaccgcccgcttgataatatcgcattggtaatagatgaaataggttaaatctaaatcgtcagtttccgcatacaaataggatttggcgtattgggcaggagcgtttttcagaagacggctgatggatatgtattcaaatagccagtagccgtttttgagcataaaccaatagaacaaagcccgcgctgtccgcccgttgccatcaccaaatgggtggatgtagccgatgaggaaatgcaagataatagcttggacaaccggatggataaacggattttccacgccgtcataggtattattggcaaacgcacacacctcttccatcagcgtatgaacctgtccgtgcggcggtggttgatacaggctgttaccattgatatcggcgataaagatttcgtcatcctgcctgaattgtccgggctcggccttgttttcaatagcgttactggtagcaatgcggtgcaaatccaaaatcatttcaacacttaacggcgtatttttcaattctaccgcttttttcatcaagtgatagttgttcactatcatgatttcgtcttttgttttgggtttacgctgcgatttgagcatatccttggccactttacgcgtggtagccgcaccttccagttgggcggatgtaatcgcttcttccataatcagagacttgagcaagaatctgttttgctcgcttctgccgaagccacccaagctagacgtgccgatagaactgccgcagcttttgtcaatcaaatgaagccgtgcctgcaaagagtcgggaatgcagaaccaaaactgatgttcaaacgggaaatcaattggtttttggatttttttgcggctttccttaacggcgcgccatttcatccgcgtatcttccgtgtgaatccggcggaatttgtcccaatgcaggtaggttccattttcatctgtcacggaaaattctgaataatctttgatttcagtaagaaaatcgggaatgtctatatcaggattgtttgcggaagaattcagcagcttggcaatttgcgtcattctttcagtgagatgctgcatatattcctgttgcaacagggtaaattccggaggtctggaaattttcatgataaataccaaaatcgcgcaattttttataattgagctattctagtcaatttttatagaaatagaaagcattaaaatacgaatctgaaagaaacgatcaccttcataaatagggaaagattgtgtctactatattaaaaaaggctgtgttttaatatggtgttgataggcgtatttggctttaaggtattcaacaggataggtttattcctaaccggaaaataattgtcttttcccttgcaaataattgaaatcaatagattactaaaacacagcctaatgtaaaaacaaattggtacaaatggcgaagataacatttggctcaaacgtaccgagcggctacgcattgaatggtaaaatacctaccgcaaattgaaagctgcaagacgacagctctactatacgttcgcaaacagaattgccgaacaaagccggataatctgtatcaaaaaattgaatctgctcaacctacagtgcatacagattaaagtcaacaaactccaccagaagatagttgcctcatccctactgctgcatatgctgaaagaaggtgcagctaaaaatggagttcatatcgaagagattaaagccaatgctaccagccaatcatgttactcttgtggtcgcttgaacaaacggataggtgttgctgccacaagaaccaatatggtttgtgagagttttggtcggcattacgacactgatgaaaatgcctcctccaatattcgaaaatagggagctgaaaagctaggcacatagagtagcagttgaccgtaaaatcataaacgcttcggaataaaaagatgtagtgatcgcatccttgcattcctttttatgttttgttgctttagcagttttacagtttagcaactgtacattttggcatttttaacttttcatatacgaaccaacatttttaaatactgcaaatattttgtacaaaatatattcattatgcctttttgatttctcatcattaatatctcgtttatattaatattgcaaataatttaaacaaattttaggaaaggaaactaattgcggtaatatctaaaatccaaagaactgcttctttcttttttaccttcttgctggttttatgcttcaacagttgtacagttttactccatgcaaaccaaacaacaaaaaaagaccgacgaagaagtcttctgcttagaatttaaagaatactggagtaggggactcccgttttccgcgacatcatttccaaatagacacggggtacgctcagcatttcatctgaaccatatccatctttttccccagttttaaccttgtgaaacatccagtcctttttcaaatcttcagacagaaaagaaatactttcctgtttgattgacttgaagagaaccatcctaccatcactcttgtaagaaaaggcagtatctaatacctatcttctagagtcgatatactcccttgacgaaaaaaatgatgatattacggataccaaaactaaggtcgtatccgcccccccctactctccctaagcaaagagatgaaacagcgtatcgactccctgccggttgaattttccgaaaaaacgcgacgtaaccagcatcaacatatataagaacagcacaaatagcatcaatacatcaggcaacgaaaatgcagaataatgcacttaatggtgtttggatatctgttgttttgtgctgttagtaattcttctttctgtgtttacagtttagcagttgtacagttttatagtaatgtttaaacaatgactgatttattttaaatgcagatattgtagaggataaaaatggccaaagtcctttcagtaacatttttgattttttagcgagccttctcatttccccagcgagatcggcaatggcagcggtactttggccgccgatatgcttaagttcagtaaccttagtgcgtaaatccagtaaccttaagttacgtaaaccattagctggcagggtgtgagttcgatttgagcaagcattattttgtctcctgttgtacggtttcagacggcatcggtttgccacgtttgtaccaagtggcgcgggaaatgccgagactctcccacggtttatcgcagctgcaattttaaactcctaaaataagtttgccttttttgtactaattactgcttggatagtttagattagacttaagtaaatttcgagtgagttgtttcacaccctacccgaagctctaaaacgcacagaaatcgccgcagcgcgccaaaaactgacagagctgcggcggatgttggtgagtaaaggaggttaatttaatttcaggttaggactttccaattcaaatttctgtttttccagaacctgattgatttgctcatcagacaatccagcttctgttagggatatacgaagttgttcaacacgttgaaggaaagcctgtttggcttgatacacaccatcagcgataaattgtgcgttcaaatcactttcaaggcggtaaaacttaatgtttgaaatacaggagtaaaaccaatcaaaccgagcggtcagttcctgaatggctattgttccgtgtgcttcactgatgccttcacggcctagataaacactgccctgaatgttctcaaatccatgtctagccaagatggttttaatatcggagtaggcattggtatagttatttccgtggtaattgtctttcaggcagttggtatccatatcaaaggtaatcaggtaacggctcattatttttctcctgttgcgtttcagacagcatcggtttcccgcgatagtaccaagtgcggcggctgataacgagcttttcccacggtttatcgcggctgatagtgttttcggcgaggtagtcggcacgtgtttgagaccaccagcgagtgattgtgctttcagctacaataattttgctgcttgccctatgtttaaaaatctatccatattggatagtttagattagacttaagtagatttcaagtgagctgtttaacccttagctagcaagggttttggtggcgtaaggttactgaacttaagcatatcggcggccaaagtaccgctgccattgccgatctcgccggggaaatgagaaggctcgctaaaaaatcaaaaatgttactgaaaggactttggccatttttatcctctacaatatctgcatttaaaataaatcagtcattgtttaaacattactgtaaaactgtacaactgctaaactgtaaacacagaaagaagaattactaacagcacaaaacaacagatatccaaacaccattaagtgcattattctgcattttcgttgcctgatgtattgatgctatttgtgctgttcttatatatgttgatgctggttacgtcgcgttttttcggaaaattcaaccggcagggagccgatacgctgtttcatctctttgcttagggagagtaggggggcggatacgaccttagttttggtatccgtaatatcatcatttttttcgtcaagggaatatacacggaggatgattcaaaaccggcaggcaaaaaaagaccgcttctgaactgcatcccaaaagttggacaccttaccgactttagggggtgcagttttttatggcaaaatattcagatgaattccgacttgccgtcgttcaatactatttggcagggaacagcagaccatctttctatttccgattcattggtacgcagatgggtgacaaaatacagattacacggagagagtggcatcaaacgtagaaagcatacgacaaaatattcggtcgaatacaaacttgaggcaatccgcctggtggcggggtagggaatgtcccaaaaagctgccgcagaccaactgaatttgcccgactgctccatcttgctgcaatggttgcgcctctaccatttgaatggtattaacggtttaaagcccaaaccctaaacccaaaggaagaaagcccgtgaaaaaacagcatccgccggaaacgaaaaagccgactatctgaaaaccaaggaagaactgcttgcggaattggcttgccttaaagcggaaatggctgccctaaaaaagctcgatgccttaatctatgggaaagaagtgcggtagaaagaacgcaactcgtcgcagggttaaggcaatgccatccgttgaactgctgttggtgattgtcggactgccacgcggcaccttctattaccaattggttgtccaatcggcagaagacaaatatgccgatttgaaacggcatatccatgatatttatcaaaagcagttgaaagacaacggtctggttcagagtatgtcccgcaagggaaactgcttggacaatgcggcaatggaaagtttcttcggaacgttgaaatcggaatgtttccatacgtgcaaatatgattccgttaccgaattggaagctgtactgcacgaatatatccgttactacaacaacgatagaatcaagttgaaattaaaaggactgagccctgttcagtacagaattcagtccctgaaagccgcttgattaaactgtccaacttttgggggtcagttaatatcggttccaccaatagtcgtcagggttgtagttgggggtctgcctgtatgcctatgccgataagctgagcacctttgagggtggtatccccgccgcttcggatggtggtttgtccggccgtactgccgacatgggtgtggcggtgggttgcttttgtctgattgctgtggtggcttgttgaaaaaaagatagtgtatttcacggtcaaataactttacatttcttgaagttgcaagaatgcgcaccccgactttttcgggatgtttgtttcgttttgaatggatttgatgttttaatttatactttattttcaataaattgaaaatcaccggcgaaagcccagtttaattttttatttatatctttccacttggaaatcttggccgttttgcaaaatcgtaaacgctattaccgccagtttccgcatgatggcaattaatatcaattttatatgcttccctttatttttcagacgccctacaaattcagggaaggcattacaacgatatgcaacaagtgcaggcatataaaggcttttccttatttccgaacttcctatttttgatattctgctttttccgttcacgcttgttcctgattgaaattttctagggtctaggcctagataagccgtgaactgtcttgcatttttaaattcatgtcttttataggttgatagcaatactgctgtcgcttgctcgcctatgcctgttattgttttcagccttttgcgtagattgttataacttggattgtctttgtagaactggagtaattgctttttgactatctgtatttgtgctgtcaggtttgaaatagttgtttgaatatgggatttgatatagtcgggtgcttcgtgttgtttagctttttctgttgcgcgttgctgtttcagatagtctaaatatcgggcgatttcctgtaattgcttctgttcttttgtcggcggtttccatgcttttaatttgtgctttcggtcttggcaatattgggctatcaactttgcgtcttgtgtatctgtttttgatcgttgtagttctgctatcgcatatccttttatctttcgtggattctctacggtaattgtatatcttgaataaagatattcggctaatgcttcgtaatatgtgcctgttgcttcgcacacgcaatggagcttatcgtttactttatgactttgtagccaatttattaattgttcaaatcctcctttgttgttctgaaacttcttttgataattttgaccgtctacaatcaaacagcaatctattgtgagctttgaaacgtctattcctaagtacatggtttaaccttattaattcgggctttttgccctagatagtgttcaaacttaagatgtacgaaagcccacgcttctatctttcttacaagctgtacgctttggccgtactttcgaagtcgtgggctttacttggtgtttcgtcaaacgccaagccctcaatgggctgatttactcattcagggcttgaagcttatcgcctttgccgtatctgattttattggggtcgcaggttttggtaaaggtttctgttgcgacccgaatgtctgattttttttgggcgtatctcagtctggaatcactccgttcgggggtttccggtattgaaaaacagttcataaaaaaggaaaagggggtattcataaagattgggtaaaaagcgcgcccaatctttacaaagcttcccccttttccttttttctgccctattttcctgcacctacaacccccgaacgaagcgattccagactgagacactttaaaaaaaacagccattctagcaattaacccccttcactcagctcaagccatcctgaggggtagggattgaactttctgctttacgactccgccgccaattccttcaaacggttttccgcgctcttcagttgtcgtacatgagattttgctacggctttccgcccattacgagaacttgcggcttgtccgctttcgcggactgttccacctgttccgtcctttgctgttcgtccttataaggattgaaaggcaacccgtttttcacatattctttacacattatctttgttatttctttcaagggtgttccttgatttgaatagcatgtgcaatctgattttccgccgtctatacatccggcgatttgctcaaaggtttttacttgtcggactgtgttataaataggcttgctttcgggcttttcgggtaaagtcggcacaaagtcttcaggtttcaaattgtctgaattttttaaaggcatttcctctgatgatgcaggctgctccgtcatcgtctgcacaacgctttctttttgcgcttcctgctcaatccggctgtctgtggctttgctgtaaactttaaaaatgccgtaacttttccagcctacaaaccctacaatcgcaatcaacgcccaaaccgcccaaggtacttttttcttgaacttttggtgctggcttgctgatttatagtatttaaaggcttctttcggcggtttccaacttgcgacttctacgccgcttacgcctgcgggattgtccaacgaggttacgcatttataccaataatactgtttcattccgattgccttgcgttcaaggtgtacatgctttgaaacaaggttgcggacgaatatatcaagttggctcgggtgctgcgtcatcaaaataacggtatgcccgtgatggcggagttctgtcagttcctgaatataaggcggaacgggacggcctgccgcgcgtaccggataagtgtagtgcgcttcgtcaacaatcagcactgcgccttccggtatgacatcacgaagcggggcggacatgatttgctcttccgtcagttcgtgggctttaaactgccgtttatccaatccgtcgatatggcagaaataaagcggtctgtctacctctgtgccgtcttccaatttcattttgaacaatccgtcttcgttgttcaaaatcatagagacgacgcgggaggttttgcctgtccccatgtttcctgtaaacagataaatcatgcttctacctcatcctggaaagacaaacgtcagttttttgaatgcgtgcataccaatgaagaacgagaatgcgccgaacaggtagcccaacccctgaccgaatcccgaaattaaaagaaggttcagtatgtcggaaggcatggaattgatcgcatttgacgtgtagtctttgaacttttccagcgcgatgagatacccggcataggttacaaatgtcagacctgttgcaaggattattctgacaatcagcattttcagaagtatgcctaaaagtggaatcagaccggcaagtaatggcatttatttccccttcaacgaaccgaaaacgacaaaagccgacataatgataaaggcgagcagtacggcaaaacggattttttcggcaaacacgcataacggctcatagcttgcctgatattgcctaccgaaaacatgaaaggttttcggctgcggacatacgccgttagacggtaaaaagttatgtgaagaccatgttttatcgtctataacctgcggtatgcttatatcgtgaaacatgccgtctgaaggtttgcccatctcctgacaggctaggatttccggaaaataatcgcacaaaagcccgccgtcttcgccttctttcctttctttgcgatgcctaccgtttgggcggtccggaacggcgggggaatcgggtcttgtgccgggctgtccgtccgtatcgggatttgcatcgggattcaaatcggggtcgggttcgggattggggctcgtgccggggttctcattggggttcgggttgtttgcggggttttcggcgggcgatacttcgggcagcggctgtgcgttcggtgcttccgcgcttccgggggtcaagtcgggacgcgggattacttgaacatccaccgtggtgttgccttgcgaatccctgccgaatgttgcgacaacctgaacgggattcccgttcctgtccgtgacgggacccatattcacttttgttccgggtgcgacttctactttttcggaataaccgggataaccggttgcctttatgtatttgtcgggattggcatcgactttcaacgataaaatctcttccagctttttggcatccatttcttctttgtattttgaattgcgaataagggaaaaatcagccccatttctgaaatcatcacctttattgaccaaacaatctccgccattccaattaaatgtgcaacgatttaaaacaaaattattccaatccaaagaacttaatttattcagttcttctttatgccaattccaaaacggacgtgccagcctatacatttggctttccatcaattctttgacttcggggaatctgctgtcatcggacataaggcgcataatcgaactgtcaacgccgtagcagccataggttctattaatacgtcttttgtcttcgtaccaaaggcaattactatattcgtagccttttacaaatttgtcggtttcggggtcgtattggtagccttgtgcctgtatgtcttctttgaaagtttcgtatacgtcatgggctaaaagggctgttccgacataaggaactgcccttgtgcttaatttcgcgcctaagcgggcaagtttgccgactcctgacaagacggcggcgcgggaaactgatgcagttactttaacggggactttttcaagagagcgtgcgcctgttgaactttctaatacattcaaattcaaacttttatcaaatttgtaattatattctgtatgaattcctcctccctcacctaaaactttgtatgccttaaatccattatcgttatatttttccgaaagtgcatacatcaatttcccatttttaatttctaaatctgctgaaaaagatttagcactcaaaagaaacagaaaagaaattattagaatccgaaacatcaatttttccattgccaataatgaaaaatgaatcatccttgaatttaatttcaaagcaagattcattaaaattaattctattaaaaaaattatgacatttatccattgagaaatttttcaatagaccagtttctttcaaataacaataaaacacataagaaagaggcctatcaggataagattctgacaatttatctaaatcagaatttgatatatagaaaaagtcacgttcatttttattcatggtttcaagcctcaaatgtctaattaaaagcctgattttgacaccataacttcatgcgctcaattcttaaacagaaccgccccgattaatacgggtacggaaacgccgagataaaaataaaaatccatcatttcaaaacctttttcagcagggaaacaaagtaaacggacgcgaggatgccgaatactatccagcctgtttcaagaccgctttgcaggttgtctttcggactgcattccgccaataaaagccttagcggctgaccgtccgacatcttccacaggctgccgttatattccggcctgacaatctgtccgttttctttgattcttggtactaccaagctgaaataaaggttttcagcctggtgcttctcaagacatttatttccgacttggtagtacatgccgtcttacttcatcactctcttaacgatggaaaatacaaaaagcgcggcgaaaatgcccactacaatccaaccggcttccataccgtccgcttttgcggcttccaaagcgttttttgccgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaatttggtatgtccgatgtcgcccgtttcaggagagagatacagaaagtcccctgttgatacggactggacaacatagactttctgcattcaatcagcctttcttcacgagttgaaaaccgatgactttcagtttttgggttttgcccgtagtgacgatttctacgttcaggtttgcttcgatcggaaattgggcgtttcggaactgctcgaaattggcagagccgccgaaatcgtattcagtagtagagctgcccaatgcgttgccttgggagctgtctaagggtgtggcgacaatcaggcagcaatagtcgaagctcttgccttcgatttgtccgttgatttttttaacgccgacgatgtggccttgaagttggatgttcattttttggtttccttgtgtgattaaacgtctttcgggcagacactttaagcccatgaaatcggtagtcttgcgaatttgtcgtaaatgaagttgttatagctttcttcattgttgacgtgtttttgctgttcaagctgtttttcaagattctcgtaatattcgtacatatagtaagggtctttgtacggtttgaatgcgggctgttcatgaatggcttgagctttcaaaaaggcgcagtcgtaggcttcgggagccaaagacttgggcagcttgtgatgactcggctcaatcagttcaaacagtttggctttgtccaattcgggaaaaatgaatttcagaccgtttgccgcacgtccgaactgtttttttacccattcaaggtagcggtcggctgaaatgaccttatcttccttaaccgcgtgtatgcgcgttgccttttgggcgaatcgttcgcaaatcggatatgcgccgccgaaatattcgcccggattctgcaaaacttcgaaagggataacgatgtcttttgctttgaattcaatttcaaatcgcgtccatgtgcttgttttatcgcccaactgcttgcctttttcatagacgcggacatatttggacgattcacgggagccgataccataggtcttgcctttggtcattttggcttcatcgtcttcttcccaatctgaccccaaacattcgccttttggtttgacgtgatgacaggtaaacatacctttatttcggtcttcacgggcttggttcgggctgtattcgccgttgaaaaagtcttttgcgatgtcaacgcgtgtgatttttgggcggattgcattagtcaggaatgcgaaaagtcgtgattcccagccttcttttgcgacgccgcaaccggtgccggtcagttcgaaaagaatggtattttgttggccgccaaaatggacgcgaccgtatagggcgtcttccgaacccatcaaccaacagcgctcatagaaacgaccgcccgaacctttggattctttgtagataccgaaaccgaaaacttcttcggcgagcatggacgcggcgcgaataaaatcttcgtcttccaaaagacttacacgaacgccgtatttatcgaaaaaggttttttcatgaaatgaaaagctaatttgatcaatgaaagccgaatctgatacaccgcgccgaagaggaacgcctaacaggtttcctttaccgtccgttatgtacgtttcgtaacattcgaagacttcctgaaccctgcctgccgtttcggtttctgtccccccctgttagataaggggggaagatttgaagcggttgtcggcttcctgccgtccgctagcgcgtccgtcatcacgccggcaaccgcctttgtcatcccttgcttatcttccatggtgcgaatcctcaaaaacgggcaaaaaaaagccctgttacttgtagaaagtaaaggacgttaatttttgttaatcgtcccttcttagggacgcaatatataaggtttataccgtcgttgttcctaatgcgcaatcagcgacattgttgccaattatccgaaagaaagttaagcctgatggcattgtatacacggatacctttcgtagttatgatgtgcttgatattagtgaatttagccatttacgtaagtttaacggcattcccaaagagcatttggggctgcatttaaagaaatgccaatggcattttaaatagaatctcaaattcagattttaagacaattagttaatgggaatttggtctggttatctagtacagccccaagtttttatataaaaacagtttggtaagttctcttcgtgaagtgcttatgttttgccacaaaagttccataatcatggcggcatcacccaagctccatctttccaagaaaatggcatctttgttgtggttgaaaaccgacaaactcctcttttttcgatttggccctgcctgaatcgatggcttcccgtgcggcagatatgccgtctgaaagcgaagcagcgacatttccggcatacagggcggcggcggtgttgagcaatacgatatcgcgcgcagccccttctcttccttccagcacctcattcattttcaacaaagattcctgagtattggcaactttgatttcatccaaattgcggcgggtttcgataccgaaatcttctgggcggatgtcgtattcgctgatttttccgtctttgagctcggcaacgcgtgttttgcccgtcagtgtaatttcatccaaaccgccctccccgcaaacaaccaaaacgtgttttgaaccaagttgttgcaagacccgcgacaaaatgccgcacaaatcggtgtggaacacgcccaaaagctggttcggcgcgcccgcaggattcgttaacggacccaatatgttgaaaatacttcggaaaccgagcgaacggcgtacaggggcgacatggcgcatggcactgtggtgattgggcgcgaacataaacccgatgccggtctgcctgatactttgggcaacctgttcgggagtcaggttgaggtttgcgcccatctgctccaccacgtcagccgcaccgctggaggaagagaccgaccggcctccgtgtttggcaaccttcgcgcctgccgctgcggcaacaaacatcgaagtcgtcgaaatattgaaggttttcgcgccatccccgcccgtaccgacgatatcgaccagcccctctgcattctccagcggcacttttgtcgcaaactcgcgcatgacggctgcagctgcggtaatttcggaaacggtttcaaccttgatacgcaatcctgtcaaaatggccgctatctgctccggcagaacctgtcctctcataatctgacgcatcaagtcggtcatttcatcgtaaaacaactcgttattgctgattaatcgttcgatggcctgttgcggtgtaatcattttttgtcctccgttcaatattcggacgaaaatgccgtctgaagggcttcagacggcatcacgtcagattttttgcggtttgaagttttgaaattcgattaaaaaattgtttaacatatcatgtccgtgctcggtcaagagggcttcggggtggaactgcacgccctcgacggcatattccttatggcgcacacccataatctcgccgtcctcagtccaagccgttacttccaaacattcgggcatcgtattccgatcgataacgaggctgtgataacgcgtacaggtaaccggattgggcaaacccttaaacatacccttgcccgaatgggacacgggcgacaccttaccgtgcatcagcgttttggcgcggactatcctgccgccgaacgcctcgcctatcgtctgatgcccgaggcacacgcccataatcggcagccggccggcgaaatggcgcatcgccgccacggaaatccccgcttctttgggcgaacacgggccggggccgataacgagatattgcggattcaatgcctcgatttcctccaacgtaatatcatcgttgcggcgcacggcaacttcctgccccaattcagtgaaatactggacgatgttgtaagtaaaactgtcgtaattgtcgataaacaaaagcattttgtgattaacctattgatttataatttgtttgttattaactgcatttccgatacccccatccataccctcttatatcttagcgtgcccgatgcgccctcgtgaacctggcgcagagcctcgcgttctgacaagtacgc

SEQ ID NO: 37795 - DNA, 14652 bp, Neisseria meningitidis
caaatcagagccagatacgctttcataacaaatctccaatcgataaaataatattcggttttacagaaatcaaagtgcaaccgccattaacaaaaccttgaaaaagattccgccgcgttgcacaaacagatgtttcggagcggcattttgctacaaatttcatttgaaatcaaagcctgtttgcaagtttacaatcgtttacccaaaaaagggcaattttaccccgaacctatttctttagtattagacctattatcctttacttcttaatattaacggatgtttacacaaattcccgtatacattttatgcgccatgccttctaaccaagtttgccaatgcctccgccaattcgggatgccgtttttccaactttgccgccgccgaaccgaaactctccagcgcagccttactcaaatgcagggtattggttttcggcggtttttccggtttcgggaccagcctgaccgaaacagagcgtatcgaagcatcaagccctgccaactgcggcaataccgacggtgcaatcattttcaagcgcgatgccgccatattgtttgccgccaaaaggacaagcctgccgtcttcgatacatgccgtctgaaaatgcgggtgcaggttggcaggcagcagttttttcacggcggcatccaaccgccgccactgtcccgcctgtttcaaaagtccggaaagcagcgcgtcccgcctgcccaactgttccaaattcataaaacatacacccaaaaagattgaaataccgcaaacgcgcctttatttcagacggcattagcactttgcacaaacgcttgtgttaaaatcgcgttttcgcccactattatatcaggcgcaggaattattcatgctgacaaacattgccaagaaaatcttcggcagccgcaacgaccgcttgctgaaacaataccgtaaatccgttgccagaatcaacgcgctcgaagaacagatgcaagccctaagcgatgctgatctgcaagccaaaactgccgaattcaaacaacgcctcgccgacggtcagactttggacggcattttgcccgaagccttcgccgtctgccgcgaagcgtcccgccgcaccctcggtatgcgccacttcgacgtgcagcttatcggcggtatggtgctgcacgacggcaaaatcgccgaaatgcgtaccggcgaaggcaaaaccttggtcgccaccctcgccgtctatctcaacgcgctggccggcaaaggcgtacacgtcgttaccgtcaacgactacctcgcctcacgcgatgcgggcattatggagccgctctacaatttcctcggccttaccgtgggcgtgattatttcagatatgcagccgttcgaccgtcaaaacgcctatgccgccgatatcacctacggcaccaataatgaattcggcttcgactacctgcgcgacaatatggttaccgaccaatacgacaaagtgcagcgcgaattgaattttgccgttgtcgatgaagtggattccatcttgattgacgaagcgcgcactccgctgattatctccggtcaggcggatgacaacatccagttgtaccaaatcatgaacaccgttccgccccacctcgtccgtcaagagacagaagaaggcgaaggcgactattgggtcgacgaaaaggcacatcaggtcatcctgagcgaagcaggtcacgaacacgccgagcaaatcctgacccaaatgggattgctggcagaaaacgactccctctattccgccgccaatatcgccctgatgcaccaccttatggcggcattgcgcgcgcattccctcttccacaaagaccaacattacgtcatccaagacggcgaaatcgtcatcgtggacgaattcaccggccggctgatgtccggccgccgctggtcggagggtctgcatcaagccgtcgaagccaaagaaggcgtggaaatcaaacgcgaaaaccaaacgcttgcatctattaccttccaaaactatttccgcctgtacaccaagctctccggcatgaccggcacagccgataccgaagccttcgagttccaaagcatctacaacctcgaaaccgtcatcattccgaccaaccgccccgtacagcgcaaagacttcaacgaccagattttccgttccgccgaagaaaaattcgaagccgtcgttaaagacattgaggaatgccacaaacgcgggcagcccgtcctcgtcggcaccaccagcattgaaaactccgaactggtatccaagctgctgacccaagccggactgccgcacaacgtcctcaacgccaaagaacacgaacgcgaagccctgattgtcgcccaagccggcaaagtcggcgcgattaccgttgccaccaatatggcgggacgcggtacggacatcgttttaggcggcaacctgaagcaccaaaccgatgccatccgcgccgacgaaaccttgagcgacgaagagaaacaggcacaaatcgccgcactcgaagacggctggcaggcggaacacgacaaagtgatggaagcaggcggtttgcacatcatcggtacggaacgccacgaaagccgccgcatcgacaaccaattgcgcggacgttccggccgtcagggcgaccccggatccagccgcttctatctctcctttgaagacccattgctgcgcttattcgcactcgaccgcgccgccgccatcctcaaccgcctcgcccccgaacgcggcgtcgccatcgaacacaacctgctgacgcgccaaatcgaaggggcgcaacgcaaagtcgaaggcagaaacttcgatatgcgcaaacaggttttggaatacgacgacgttgccaacgaacagcgcaaagtcatttacagccagcgcaacgaaattctgaccagcaaagacatcagcgacctgatgcaggaaatccgttctgatgtcgtcagcgacctcgtggatacctatatgccgcccgacagcatggaagaacaatgggacatcccgactttggagaaccgtctggctgccgaattcagactgcacgaagacatccaatcctggctgaaggcggacaatgcgattgacggtcaagacatcaaagaacgcctgatcgaacgcatcgaaaacgaatatgccgccaaaaccgaactggtcggcaagcaggcaatggccgatttcgagcgcaacgtgatgttgcaggtcatcgacaaccaatggcgcgaacacctcgccgctatggactacctgcgacaaggcatacacctgcgcagctatgcccaaaaaaatccgaagcaggaatacaaacgtgaagcctttaccatgttccaagacctgtggaacggcatcaaattccatattgcctccctgcttacctcggttcaaatcgaacaaaaccctgtcgcggtggttgaagagcaacccatcggcaacatccagtccatccattccgaatcgcccgatatggaagaacttttgggtcagtcgcaaaccgatctggttaccgaagcctttaatcccgatgggacagatttcagccccgaagccttggaagcgcgggggcaaatcgtccaccgcaacgacccctgcccctgcggcagcggtttgaaatacaaacaatgccacggcaaactggcttaagcgtttgaacgcaaatgccgtctgaacatcccgctcccgtttcagacggcattttgcctgaaccgccacatccgactgccattccgaaaaatcccgatttcgtaccgtccgtaccaaaaacagacatcccgtccgccccacatcatgattccatccgacttcattgacgagcttttagccaaaaccgatattgtcgatattatcgacgagcaggttccgctgaaaaaaggcggggcgaactatatggcgtgttgcccgttccacaaggaaaaaacgccgtcgttttcggtcagtccaaccaagcagttttaccattgtttcagttgcggggcacacggctcagcgattggttttgtgatggaacatcagggactgtcgtttccggaggcggttcagttccttgccgaccgcgtgggtatggtcgtgccgaaagtgcacgggcaaaacgataatcccgaagtccgtgccgaacgtaagaaaaaacagcagacactggaggaaacgacggctgcggcagctgatttttacgcgcaacagctaaaattcaatccagcggcaaaagcttatttggacaagcgcggcttgagtgcagaagttatcgcgcattatggtttgggctatgcgcccgacggctggcagcctttgacgcaagtgttccaaccgtatcctaataccgcgttagtggatacggggatggtgattgacaatgagggacggcattacgaccgcttccgccatcggattatgttccccatccgcaatccgcgcgggcaggttatcggtttcggcggcagggtgctggacgactcgaagccgaaatatttaaattctcccgatacgcctttgttcgataaggggaaaaacctttacggactgtatgaagggcgtgccgctgtcaaggaagcggggcggattttggtggtcgaaggctatatggacgtggtcgcgctggcacagttcggcgtgggctacggcgtggcggctttgggtacggcgacgacggcggaacacgtcaaaatcctgatgcgtcaggcagacagtatttatttctgtttcgacggcgacagcgcggggcgaaaagcggcttggcgcgcgctggaaaacgcgctgccgcagttgaaggacgacaaatcgctgcattttttgttcctgccggaagaacacgaccccgacagctacatccgcgcctacggcaaagcgcaatttgaagacgcgcttctgaatcaaagcaagcctttgtcggagtatttctgggaacacctttcagacggcattcatctcaatacgcaggaaggcaaggcggaattggtaaaaaccagttcgccgcttttggcgcagattaccgcgccggcattggcttatttgttaaaacaacggcttagcgagctggtcggcatcgaccccgacaacctcgcgcaactgctaggacaggaagcgccgaagcggcacgtcaaacaaaaaaactacaaactgcctccgatttccgtcaaacagcccgtcatgctgacgctggtacagcggcaaatccgcagcctcttgataaatccggattgggctgcatatatagacctgcccgattatctggcgttggacggtgatttcgcctgccttgccaatcttgccgaatcgattaaaaaccatgccgccgtacccgaaaccgctcaggttttagagtatatgcgcggctcgccttacgaagaaacgataacccgaatcttccattcaacgcaccaatcggaagaaatgaacagcagcagtgaagaagattgcgagaatttccaaatcggcatgaaaaaactgctcaatgagttaaaatacagccaaatcgaaacattaaaacaaaaaagcctgcaatccggcttaaatgaaagcgagaaaaaacttttgctgtcgctgctgaccgcaaaacaaaattgaccggcggattccgccatccgtaaaccgttatgccgtctgaaaagcattcaccccggctgcaacaacgacacctgcagaacacccatccccaaaagccttcagacggcatcagagtaccctactctgccacgccttcaggtgcgtccaaacgcaaaccgtcggcatcttaccaacagaaagcagacaatgtccagaaaccaaaatcacgaagaatatcaagacgacacccgtccgttaagcattgaagagcaacgcgcgcgcctgcgtcagctcatcatcatgggtaaagaacgcggctacatcacctactccgaaatcaacgacgccctgccagacgatatgtctgatgccgaccaaatagacaatatcgtcagcatgatttccggtttgggcatccaagttaccgaacacgcccccgatgcggaagacatattgttaagcgacaatgccgccgttaccgacgatgatgccgtcgaagaagccgaggccgccctttccagtgcagattccgagttcggcagaaccaccgaccccgtccgtatgtatatgcgcgaaatgggacaggtcgacctgctgacccgcgaagacgaaatcatcatcgcaaaaaaaattgaaaacgccctgaaaaatatggttcaggccatctccgcctgcccgggatccattgctgaaatcttagaactcatcgaaaaaatccgcaaagacgaaatccgcgtcgacgaagtcgtagaagccattatcgacccgaatgaagtattgctcaacgaattgggcttggggcacttggaaaccacagcgcccgagaaaccttccaacgacaattcggacgaaaacgaagacgacgaagaatcggaagaagatgcggatgaaatctcggcagccaatctcgccgaattgaaacaaaaagtcatcggccactttgcccaaatcgaaaaagactacaaaaaaatgattggccgtttggaaaaacaccacagccggcacaaagactatctcgcctaccgcgacgcgattgccaacaaactgctggaagtccgtttcgccacccggcaaatcgacagcctcagcagcagcctgcgcgggaaagtagaaaacatccgcaaactcgaacgcgaaatccgcgacatctgcctcgaccgcgtccatatggaacgcgactacttcatccaaaacttcctgcccgaaatcaccaatctagaatggattgaagaagaaatcgccaaaggcagggtttggagcgacgcgctcgaccgcttccgccacgccatcctcgaaaaacaaaccgagttggcggatatggaaaaagaaacccgcatttccatcgaagagttgaaagaaatcaacaaaaatatggtgtcgagcgaaaaagaaaccgcagccgccaaacaggaaatgattcaggcaaacttgcgcctcgtgatttccatcgccaaaaaatataccaaccggggcttacaattccttgatctgattcaggaaggcaacatcggtttgatgaaagcggtcgataagttcgaataccgcagaggctataaattctccacctacgcaacctggtggatccgccaggcaattacacgctcgattgccgatcaggcgcgtaccatccgcattccggtacatatgattgaaaccatcaacaagatgaaccgcatctcgcgccaacaccttcaagaaaccggcgaagaacccgattccgccaaacttgccgaactgatgcagatgcccgaagacaaaatccgcaaaatcatgaaaatcgccaaagagccgatttcgatggaaacccccatcggcgacgacgacgattcgcacttgggcgacttcatcgaagatgccaacaatgttgcgccggccgatgcggcaatgtacaccagcctgcacgaagtaaccaaagaaatcctcgaaagcctgacaccgcgtgaggcaaaagtcctgcgtatgcgtttcggcatcgatatgaacaccgaccacacgctggaagaagtcggcagacagtttgacgtaacgcgcgaacgcatccgacaaatcgaggcaaaagcactccgcaagctgcggcatccgacaagaagcgaccgtttgagaagtttcttggacagcgaagacagcaagctgtaaaccaaaaaaccgcaggtttcaaatacctgcggttttttcttacacaataaacaacgcttccacatatcccacactcctatcccgagacctttgcaaaattccccaaaatcccctaaattcccaccaagacatttaggggattttccatgagcaccttctttcagcaaaccgcacaagccatgattgccaaacacatcgaccgtttcccactattgaagttggatcaggtaattgattggcaaccgatcgaacagtacctgaaccgtcaaagaacccgttaccttcgagaccaccgcggccgtcccgcctatcccctgctgtccatgttcaaagccgtcctgctcggacaatggcacagcctctccgatcccgaactcgaacacagcctcatcacccgcatcgatttcaacctgttttgccgttttgacgaactgagcatccccgattacagcaccttatgccgctaccgcaactggctggcgcaagacgacaccctgtccgaactgttggaactgattaactgccaactgaccgaaaaaggcttaaaagtagagaaagcatccgccgccgtcgttgatgccaccattattcagaccgctggcagcaaacagcgtcaggccatagaagtcgatgaagaaggacaagtcagcggccaaaccacaccgagtaaggacagcgatgcccgttggatcaagaaaaacggcctctacaaactcggttacaaacaacatacccgtaccgatgcggaaggctatatcgagaaactgcacattacccccgccaatgcccatgagtgcaaacacctgtcgccgttgttggaagggttacccgaaggtacgaccgtctatgccgacaaaggctatgacagtgcggaaaaccggcaacatctggaagaacatcagttgcaggacggcattatgcgcaaagcctgccgcaaccgcccgctgtcggaagtgcaaaccaagcgtaaccgatatttatcgaagacccgttatgtggtcgaacaaagcttcggtacgctgcaccgtaaattccgctacgcccgggcagcctatttcggactgattaaagtgagtgtgcaaagccatctgaaggcgatgtgtttgaacctgttgaaagccgccaacaggctaagtgcgcctgttgccgcctaaaaggcagcacggatgcctgattatcgggtatccggggaggattaagggggcgtttgggtagaattaggagatatttggggcgaaaacagccgaaaacctgtgtttgggtttcggctgtcgggagggaaaggaattttgcaaaggtctcatcctgttattttcacaaaaacagaaaaccaaaaacagcaacctgaaattcgtcattcccacgaaagtgggaatccagtgcgttgagtttcagctatttagaataaattttgaaactctaatcgcgtcattcccacgaaagtgggaatccaggacgcaaaatctcaagaaaccgttttacccgataagtttccgcaccgacaactctagattctcgcctgcgcgggaatgacgaatccatccatacggaaacctgcatcccgtcattcccacgaacctgcatcccgtcattcccacgaaagtgggaatccagttttttgagtttcagtcattcccgataaattgccttagcattgaatgtctagattcccgcctgcgcgggaatgacgggatttgagattgcggcatttatcaggagcaacagaagccgctctgccgtcattcccacgaaagtgggaatccagttttttgagtttcagtcattcccgataaattgccttagcattgaatgtctagattcccgcctgcgcgggaatgacgaatccatccatacggaaacctgcaccacgtcattcccacgaacctacattccgtcattcccacgaaagtgggaatccagttttttgagtttcagtcattcccgataaattgccttagcattgaatgtctagattcccgcctgcgcgggaatgacgaatccatccgtacggaaacctgcatcccgtcattcccacgaacctacattccgtcattcccacgaaagtgggaatccagttttttgagtttcagtcatttccgataaattgccttagcattgaatgtctagattcccgcctgcgcgggaatgacgaatccatccgtacgaaaacctgcaccacgtcattcccacgaaagtgggaatccagttgcttgagtttcagtcatttccgataaattgccttagcattgaatgtctagattcccgcctgcgcgggaatgacgaattcatccgtacggaaacctgcaccacgtcattcccacgaacctacattccgtcattcccacgaaagtgggaatccagtgcgttgagtttcagtcatttccaataaattgccttagtattgaatgtctggattcccgcctgcgcgggaatgacgaattcatccgtacggaaacctgcatcccgtcattcccacgaaagtgggaatccagttttttgagtttcagtcattcccgataaattgccttagcattgaatgtctagattcccgcctgcgcgggaatgacggcggaaatcttgtttatattgaatcaaaaaaaacctgcaccttaatcagttggcggtttagtccgacttttggggtgcagatcaagctttcagacggtatttcctttaaaacttcatttcgagcgcgagactgaagttcctgcccggtgcggcataccttccatagttgctgtcgccgccgtgccggtttgccgtgctttccgcagtctggcgcaaggattcccaagtaacgtagcggtagttgccgatattgtagatagccgccctcaaggtcagccgttttttcagattcagataggcggaaacgtctgccgtcgaccaagaagacgacgctctttttgtcgaatatcgtttttgatcgcctgccagataagcaagctcgtcagggtttttccctttggaataggtcagcataatgtttgcgccccatttcccctcaggctggtcgtatccgaaccccaaaacataacgcgacggctgtaccgcatccaaagcatagctgcggagggacagtcccggccggttggataccgatttcggtttgatgcggttgtacgccaatgtggtgtacaaaccttcgggcagtttgccatacacgccgttccagtcgatttttcccaatatattaacgccttgaagcgacatattttgggcattgtaataatcgcgtatatcaatctctgtcaattgtcctgcctgattcggcaatttggttttgtgatcggcaacggcaatcatatcggtataacggttgcggaagctgctgatttccaaaaagccgaaatcgcccttccactgcaaaccgatttcccggttggctgccttttccgatttcagggcgggacgctgccagcctttcggataatcgtgataaatgtctatcccgaaaagttcttggaatgagggcgttctgaagccgctggaggcacggtaagacacggaaaaatgccggttcggtttgaacaagatgccgctgttccacgaacggtcaacataccgcccgctgcggacgagttcttccgacgtggtgaagtttttccggtcgtacctgccgcccaagctgaaatcgaaatatttgccgattgaaaaacggtcgttcaaagaaatatggatattgctgccgttgatttttcttggcacgcatttgcgggaacgcagggtttcgatgtagccgcagaccgacccttcgacgacttcgggcttacccaaaagatacttatcttgattgttttcatcgaatcccgtggattccgaaatccttgccgcattgtgggaaagctgttcggggcgggaaatcgctttggaagcatcgtaaccgaagcccaaagtcagatggtgtttcgtccatttgtttttcagcgatttctcaaacgaggcattcaaaacattgtgctgttcgcggtagtggaaacggtcgctgctgtcgtaggaatacggtttgtccgccgacgcgcggcaggatttgtccacagcaggatacacggcgcaattcagcttcagcgtgttgttatcggttgccacgccctgtttgtcaaacgacaacaccgccttatccgcccaattgtcagaatacgcttcgttttcataacgatacagcaaacccatacggcggcggcggtgatgttcgtcaataaatttggtgcgggaatatttcaaacctatgcccctgaccaaatttttatcgcccttccactcttctatattcggcacaaaatacaagccgtcgcggaaatcgtcgccgtcgtacaccccgctcttgtctctaaacttttccgcctcgtccgtaccgtaatactgtttttccgtcatatcgcggatatcgtaacgctgtttggtatcctcaaacacgccgccgacataatgcctgccgccgaagcggtagcccagcttggcaagccaagagccgctgcggtaatccatcggatcgggcaatatcctgccgccgcccgtgtaagcttgggcggacagattttcgtggcgcgcctgcgcctcccgcacctgcgcctcttcttcagcacttaaaggctgattttgttcaatacgttcttttacccagcggttgagctggttgttcaaatatttcccgtagcccgccaattttgccacgggcttggattcacgctcgccctctactgagaaaaatggctctcttgtcttgcgtttaatatcgtatgtctgacggaacgcgtccaaacggtctatgccgtattccaccccgtccgcaatatcgccgtgcgggcgcgtttcccgcccttggcgttcggttcggattaacagcccttcccaaccgtctttgctgaaccccgcgccgagcgacttcataaattggcggtttttactgccgtaggcggtttttgcctgtatcccccaacttttgccgtctgaaatcaggtctgccgcctctttggtgcggaaggcgaccgcgccgccgagtgcgccgctgccgtgatcggacgaaccggcacctttgtcgatttccaccgtgctgatgttttcatattcgatttcgttgattgcaccgctgccgccgcgtccgccgtatccgctcaacgatccctgcacggtaaacgcctgtatttgggcaacaccgtcgaccgaaaccgccacacggtttttatccacgccgcgtatcgagtagccgccgctcgcgccgttgccctgttcgacaaccgccacgcccggatcgtagcgcgtcaggtcgcggataccgagtacctgttctttgttcaacgtttccgacgttttgacgattttgcccaaaccggtcgcctctttcgatcgccgtcccactttggcggcacggacggtaatctctttcagggattgggtctgcgcggcatcaggtgtcgccccccccgcttgggcagcataagccggaaaagcggttgcaatggccaaggcagtcagagtcagcggaaaaccgtgtttcttattcatttttccacctcctgcatatctttcttcgcaccgaataccacgccgaattggtgtttaacttcagattctaactgtttgccaacatcaacttcagcatcaacttcagcttcaacatcaactttattttcagtaccttcagttataccaagagatttcccatcattattgaaaataataccgcccaattcctccgcctgcgggccgtaaaatcccccttctacacgaagattactagcttggaaggttttggggtcggtcgaaccatttcccgaaagattgatgccgttctcccgagtgcgtgctgtcgcgtagaaaccgttgccctcaatcttgccgttttcaatatggaaagcaggttctacaccgttttcctccgtcagcgttccggaaatcgatttcttgccgaaatcaacggtaaatactgcttttgccgcttctttatccgcctgattgtcccattgaatgggtttgccgatacgcgcttcccaagtgccggtatagtgtgcttctccagttttcggaatatccgtttccgccgtgcggatacctttcaggaaaaggtcgatgttcctgcctttaggggcttccggagcgggcaggatgccgtctgaaccgctgccgccttcttctgtcggcgattcttcttcgggttcttcagcttcatcttcaccttctacggcttcgtcttcttcgctgccttcgtcttttacggctgcgtcttcggtgccttcttcatcgtcgatttcgtcttcgccttcttcgacgctatcaacgcctgtatcctcttcgtccctctcttcgtcctgcgccttcggtttggcggcgggacgttcggtttgcatccgtccgattttcacataggtcagaaaatcgcagcaggttcggattgtcgttttcctaccatcggcaagctcgatggtttgttctttgtttaccaaaggaatttcacgcccttcgacaagaagtttgtcgggatgaccaaaatcgggcatagaggaaatggcaaactcacggggatttttatcacttgcctcgtcaacggaaattttcagagaatccaagattttggtgtgttttccagacgacagggcaggttttgtatctgctgcgttttctgtctctgttttttgtttgcctgcgaatacgccgaatacgctgttgtcgttgctgataaaccgtccggcaagctcttctccgttatcgccgaaaaaaccgccctcaagccgctgatcggcatcggtatggaaaaacaaatattctttatcagcgtgttgcgtcttcacctcggtgctaactttggcactgccggtaaagcggttgccgtccaatgttgcggtaatgtcgtaaatggtcagcggttttttgggctcatttggattacttttattttgcacatactgatttttaatcagcttgccattcagggttttgttatcaaaatcaaccgtatattcggcaggatgcttttccctgtcgtcggcatccctagcctcataagaagttgc

SEQ ID NO: 37796 - DNA, 8367 bp, Neisseria meningitidis
  misc_feature (8323)..(8323): N is any nucleotide
tttttggatagcgtgccaaatgctgctgaatttgctcaaccgagatggcaagccttggcgacacctcaaagccttgttttgccaagcggatcggtgtatcaaataattttccccaaggcaatacaccgtatcgctgatgtattgtctccatcagtttagggatagcaggcgtacccaccgagcgaccaccggccaccggttccataaatttcaatggttgaccatctttatccaaaaataattccggcgtcgcacgcatcggtgccgtctcacgcccatcaaatgtggtcaatgttttggcggtattatcccaatacaacacaaatgcaccaccgcccaagcctgacgactgtggctctaccaagcttagtgtcgtctgcaccgccaccatcgcatctgcagcgctaccgccttgctttaagatatcatagccagcttgtgttgctaatggattggctgacgctaccataaaatcacttgcaagaccaggtaaggttcttcgcgttgcatcgaattaatccacatcatccaccgcttgtgcgggtccccgtcaattcctttgagttttaatcttgcgaccgtactccccaggcggtcaatttcacgcgttagctacgctaccaagcaatcaggttgcccaacagctaattgacatcgtttagggcgtggactaccagggtatctaatcctgtttgctacccacgctttcgggcatgaacgtcagtgttgtcccaggaggctgccttcgccatcggtattcctccacatctctacgcatttcactgctacacgtggaattctacctccctctgacacactcgagtcacccagttcagaacgcagttcccgggttgagcccggggatttcacatcctgcttaagtaaccgtctgcgcccgctttacgcccagtaattccgattaacgctcgcaccctacgtattaccgcggctgctggcacgtagttagccggtgcttattcttcaggtaccgtcatcagccgctgatattagcaacagccttttcttccctgacaaaagtcctttacaacccgaaggccttcttcagacacgcggcatggctggatcaggcttgcgcccattgtccaaaattccccactgctgcctcccgtaggagtctgggccgtgtctcagtcccagtgtggcggatcatcctctcagacccgctactgatcgtcgccttggtaggcctttaccccaccaactagctaatcagatatcggccgctcgaatagcgcaaggcccgaaggtcccctgctttctctctcaagacgtatgcggtattagctgatctttcgatcagttatcccccactactcggtacgttccgatatgttactcacccgttcgccactcgccacccgagaagcaagcttctctgtgctgccgtccgacttgcatgtgtaaagcatgccgccagcgttcaatctgagccaggatcaaactcttatgttcaatctctaactttttaacttctggtctgcttcaaagaaaccaacaggacaatgttcaaaacattatcttgtctgtctttcaaacagtgtgagactcaaggcactcacacttatcggtaatctgttatgttaaagagcgttgcgaattataaagtattccttccgcctgtcaagatatctctcgatatccccaacattctgtgctatacttttcagttcgtccgccacttctgcagcagcgaagaaccgaactatacgcccacagggaaaaacggtcaatgctttcagcgggatttttttggggaaattcgtcatgtcgctgtcggataaggttttttatttctgctaaatactgcgccgcctccaacaatcctttcctctccctcctccggctggtgcgcctttgtgaatatgctgtctgaaactcggggactcagacggcatctgttggctcttcttatcttttcagaatgatttccaatacgaacttgctgcccatataggcaatcataaggctgacaaatccgatgatggtccacacggcggcttttttgccgcgccatgcggtcatgctgtgcttgagcagcagtccgccgtaaatcagccatgacaatatgccgaatacggttttatgggtaaaggtcatgggtttgccgaatacggcttcggcaaaaaatgttccactgacgacggaataggtcagcaggatgaaacctgcccacatggcctggaacatgagtttttccaaactgagcagcgacggcaggaatcctgcgagcttggagaagctcctgcggtgcaggctccgattcagcagcagggtcaaaacggacaataatgttgcgatgccgaacagcccgtatgcgagcagcgaagttccgatatgcagcataaagggaaggtcggtaatttcatatcccgagaattttccaggaaaaaccaaacctgacagcagcatcagtgcggcgcaaggatacagcagcaactgcactccgcgcagcggataaaagaagctgccggcaaaataaataaacagcatcatccaaacaatcaggctgccggaatacccgaagcccataatgatgattttgtcttgaatgaccggcataagcagtgccgcgccgtggacggtcaatgccgcacccaaaaccggcaattccgtcttccacgggtaatcccggccgcacccctgctgttggcagtgccatgcaaatgcacccaatcctgcgtaaaccgccgtcaaaaagatgaaaactgtcggcatggtggactttctctatctatactgttgcgccgtatgcggccgcttatgaaatattggaacttttaacgttggaattgtaaaatccccatttcggtcaagccttgacggatttgccgatatgctgtccggcacacaagccgcatcaaattattttgattttattttaacaaagaatgcccctgatggggcaagctattcttattcagaccaaggaccagtatgttagacaatttaaccggccgcttcagcaatgtcttcaaaaacatccgggggcaggccaaactgaccgaagacaatattaaagaggccttgcgcgaagtccgcctcgccctgcttgaggcggatgtcgccctgcctgtcgtcaaagagttcatcaacaacgtcaaagaaaaggccctcggtcaggaagtagcgggcagcctgacgccggatcaggcatttatcggcgtggtcaacaaagccctgaccgaactgatgggcagggaaaacaaaacgctggatttgtcggttgcgccgcccgccgtcgtgttgatggcaggtttgcagggcgcaggcaagacgacgaccgtcggcaaactcgcccgcctgttgaaaaacgatcagaagaaaaaggttttggtggtatccgccgacgtttaccgtcctgccgcgattgaacagctgcgtctgttggccgaacaggtcggcgtggattttttcccgtccgataccaaccaaaaaccggttgaaattgcaactgccgccgtcgattacgccaaaaaacatttttacgatgtattgatggtcgataccgccggccgtttggcaatcgatgaagagatgatgaacgaaatcaaagcccttcacgcggcggttaacccggtggaaactttgttcgtcatcgatgcgatgctgggtcaggatgcggtgaacactgctcaggcatttaatgaagccctgccgctgaccggagtcgtattgaccaagatggacggcgactcgcgcggcggtgcggcattgtccgtacgccacgtaaccggcaaaccgattaaatttatcggtgtcggcgaaaaaatcaacggcctcgaacctttccaccccgaccgtcttgccggccgcattttgggtatgggcgacgtattgaccctgattgaagacgttcaaaaaggtatagacgaagaagccgccgctaaaatggcgaaaaagctgcacaaaggcaaaggcttcgacctcaacgactttaaagaacaaatccagcaaatgcgcaatatgggcggtttggaaaacctgatgtcgaaaatgccgggcgaactgggtcaaatctcgaaacaaatccccgaaggaacggctgaaaaagcgatgggcaaagtagaagccatcatcaactcgatgacccctaaagaacgcgccaaccctgccctgctcaaagccagccgcaaacgccgtattgcaatgggtgcgggcacaaccgtgcaggaagtgaacaaattgctcaaacagtttgaacaaatgcaacaaatgatgaagatgttcagcggcaacggcttgggcaaactgatgcgtatggcgaaaggaatgagggggataaaagggatgttcccgggtttgtaagccgatttaacagaaaacgccgtctgaaatttcagacggcgtttttgttttatattctgatttatagtggattaacaaaaatcaggacaaggcggcgagccgcagacagtacagatagtacggaaccgattcacttggtgcttcagcaccttagagaatcgttctctttgagctaaggcgagccaacgccgtactggtttttgttaatccgctatatattctgatttaaaaccataaggctttaagcaatcatctcttctataaagcctaaatacaaaaggccgtctgaaatcctattttcagatggcctttactcattcaatcctcaacttattgcggctttttctgctcttcgcgtactttatccaccaactggtcaatcgtggtcataccggactgccagtctttaaattcaacttggtatttgccgccgacaatcacagtcggtgtgccgctgatttggaatttattggtcaactcttccatttgagccgcacgcgcttggctttcaggagcctcaaatgcagccaatacttttttgccgtcaaacgctgtttgctcggacagccattttttcagggtatcggtatcggccagattgattttttgattaaccatcgcatcgaaaatatggctgttggctttatctgattcaccggccatttccactgcggccgccaaacgtgccaaaggtttcatttcatcaccccacacgacatgctcccggcgcatataggtatcgtctttaaacgttttgatgtgctcgctcaagaccggctcaagatgggcgcaatgcgggcagaagtagccgaaaaattccaatacttcgattttaccggcctgctgttgcggaataggcgtagacaatacagtgtagttcacaccttcgttcaactcagcaggggctgccggagcagatgagctgctttgggcgctgtctgccggaacactggtttcagcctgtttgctacaagcggccaatgccaacagggtcaatgaagtcaaagctaaggttttcagtttcataggtatctcttgtgtgtcagattaatgtgcggattttatggcattttattgaaggcgtgttcgatttgagtgaaaaaatgtgtttagttttatttcagcctttgcctgatttcatcagaaacggtaatttacccgggcagtatagccgcgcggattacccggcatagagtccgaacgccaatatttttgattgagcagattggctgcggcaaaggtaacgttaacatttttatggttccagccaagcatggcatcaactcgggcaaagcctggaagcgtagtcacttctttatttcttgagttgtaaccgtagcgtttgcctgtaccggttacgccgatttcgccgtagaggttttcggtcggggtataacggaaaaacaggttgccggtaacgttgctggtattattcaaatggatgcccactcggtcgggattttctttgtcttcaacgactttcgcctgcatcacgcccaacgaaccgcgcagatagagttttttggggatgatttgcccgatggcggacaattccacgccgcgcgaacggtgtttgccgctaaccgcataaatataagggttgttttttggatcggggcggtagcggatattgaagcgttcgatttggtaggcagacaacgtagtgctgaggcggtcgtccagccaactgcttttcacgccggtttcgtattggcgggtgtactcggggtcggcgttgaacacggcggaagacaacgtatcgatgctcaaatagccgccgcgtccgccataaggcgcgaagcctttgttatacgaggcgtaaagtgtgtggacgggattgatgttccacactgcgccgatgttggggctgaacgagtgtccgctgtattggcggctgctgccggtgagtttgttttcggaattaaaggtgtatttgtcgtaacggccgccgaggacgaatttcaaatcgggcgtggcggagaagatgttttgcacaaagatgccgtaggagtcggctttgtggcggttttgggtcagaataggctgcaatctgcccgaagccggccagcttgcgcggtcgtaggggttgatggaggcggaaaaggcgctgctgaaacccaatgtcgggttgcggtgttcgcggctgtaatccatgcctacggtcaggtggttttcaaaacggccgatggtgtagtcgccgttgagcgttaagttggacgacagggttttgttgtcggtctgctgccaggcgtagttacgtttgattaagttgccattttcgctgcctgcatagaaatgatcaaaatcctgcgccgccgtgcggtgggcgagctgccattgggcacgccatttgtcgttgaaggcgtattcaaggtcggaacgccaaacttgcagcttgtctttgacaaaatcgttccggtgggcgaaccccatgcggtaaggcagtccgaagcggtcgtacacggacttggtcggactgcggtcgggcgtgcgctccacattgtcgtaggtgtattgccccgtccacttcaagccgttgtcgagtttgacggtaatgctgggcgaaaccatgacatttttgctgtctatgccgctgcggaacgaattggcgcgcccgacttcgccggtgagacggatggcgacgtttttgttcagcacttcgttaatgtccatattcaggctgcggtttgcccatgagccgtaaaccgctccgatgttgcggctttgtttgaagttggcgtatttgctgaccatgttgatgacgccgccgccgttggtgcggccgtaaagcacggaagacgggcctttcaggatttccacgcgctcgatgttggcagtactgcggcgcacttgtccgctttcgcgcacgccgtcgcggtaaatatcggatgcgtcggcttgaaaaccgcgcaggaaaatgctttcaccgcgcatatcgtaggcagcgtcgatgccggcattgccttcgaggatggaactcaaatcgttcgtaccgtaatttttgtttttctggatattgagcgtatcgatggtttgcggcgtttctttgatgagctgtccgttgcgggtaacggcggcttcgtcgtagttgatgtagcctttgagtacgctggtgtcggactgtccgaccacggaaacggtgggcagagtggcggtgtaatgttcaccattgtcctgcgtatcggcggcagcaacagggaaggaagcaataatcagcgtgggtaataaagctaaatgaaatgatattttcatttttatactcaatttaacaaaacaaccgaattatattgcctcacggaggaaatgagaataatttcttttaactatattgaacatgatatttgtaaacaaaggtctcagaatgcggaaaactcgccgcctgatactgaaaaatgccgtctgaacagggttcagacggcatttttttgaccgcgaaattatgcgccgaacactttcaaacgttctgcaacgggttcaaaggtcttttcacctgccgccccttcaataccgccgataaccatttgtgcgcgcaacaaccagttttcggggatattccacgctttggcaatcgccgcatcgggcaagggattgtaatgttgcaggtttgcacctacgccgaccgcggcaagtgtcgtccaaacggcatactgcaccatcgcgtttgcctgatccgcccaaacggggaagttagcggcataagcagggaactgctcctgcaaacctttgacgacattttgatcttcataaaacaaaatggttgccgcacccgccttaaacaggttcaatttttgcgcggtcggttcaaaactgtcggcaggcacgacggcacgcagcgcgtcttcgacaaattgccacaccttatcatgctcttcgccaaacagcacgaccacgcgggcagattgggaattgaacgaagaaggtgtgtgcaaaacggcgtgttcgacgatttggacaacttcatctttgccgacgggcagatttttatttaacgaataantggaacggcggctttcggcagcctgttgcagagattgacgggtc

SEQ ID NO: 37797 - DNA, 13732 bp, Neisseria meningitidis
cagcgcgccgccctcggcattcccgccctccctttgaacgcgcagcaaaccgccgatttggttgagctgctgaaaagcccgcccgcaggcgaaggcgagttcttggtcgaactgcttgcccaccgtgttccgcccggtgtggacgatgccgccaaagtcaaagcctcattcctggctgccgttgccgaaggcagcgcgtccagcccgctgatctcccccgaatatgcgaccgaactcttaggtacaatgctcggcggttacaatattcacgccttaatcgaactcttggacgacgacaaactcgcgtccattgctgccaaaggcttgaaacatacgcttctgatgttcgattccttccacgacgttcaagaaaaagccgaaaaaggcaacaaatacgcgcaagaagttttgcaatcttgggcagatgccgaatggttcgcctcacgcgccaaagttcccgaaaaaatcaccgttaccgttttcaaagttgacggcgaaaccaatacagacgacctctcccccgcgcccgacgcgtggagtcgtcccgatattccgctgcacgcgctggccatgctgaaaaacccgcgcgacggcatcacgcccgacaaaccgggcgaagtcggtccgattaaattgttggaagaactcaaagccaaaggccatccggttgcttacgtcggcgacgtggtcggtactggttcttcacgcaaatccgcgaccaactccgtcatttggcataccggcgaagacattccgttcgtgccgaacaaacgcttcggcggcgtatgtttgggcggcaaaatcgcgccgattttcttcaatacccaagaagattccggcgcgctgccgattgaagtcgatgtatctgctctaaaaatgggcgatgtcgtcgatatcctgccttatgaaggcaaaatcgtgaaaaacggcgagactgttgccgagtttgaattgaaatcacaagtattgctggacgaagtgcaagccggcggccgtatcaacctgattatcggccgaggtctgaccgccaaagcgcgcgaagccctgaaactgcctgcctctactgcattccgcctgccgcaagcgcctgccgaaagcaaagccggtttcaccttggcgcaaaaaatggtcggccgcgcctgcggtctgcccgaaggacaaggcgtgcgcccgggtacttactgcgaaccgcgtatgacgacggtcggctcgcaagacacgaccggcccgatgacccgcgacgagttgaaagacttggcttgtttgggcttctccgccgatatggtgatgcagtctttctgccacaccgccgcctatccgaaacctgtcgatgtaaaaacccataaagaactgcccgcctttatttccacccgtggcggcgtgtcactgcgtccgggcgacggcgtcatccactcgtggctcaaccgcctgctgctgcccgataccgtcggcaccggcggcgacagccatacccgtttccccatcggtatttccttccccgccggctccggcttggttgcctttgccgccgcaacgggcgtaatgccgctcgatatgcccgagtctgtattggtacgcttcagcggcaagctgcaaccgggcgtaaccctgcgcgatttggtgaacgccatcccgctgtacgcaatcaaacaaggtttgctgaccgttgccaaagccggtaagaaaaacatcttctccggccgcatcctcgaaatcgaaggcctgcctgatttgaaagtggaacaagcctttgaattgaccgacgcatccgccgaacgctccgccgccggctgtaccgtgaagctcaacaaagagccgattatcgagtacatgaaatccaacgtcgtgttgatgaaaaacatgattgccaacggctatcaagacccgcgcactttggaacgccgcatcaaagctatggaaaaatggctggcaaatcccgagttgctcgaagcggataaagatgccgaatacgccgccgtgattgaaatcaacatggacgacatcaaagagccgattatcgcctgcccgaacgacccggacgacgtgtgcttcatgtccgaacgctccggcaccaaaatcgacgaagtattcatcggttcgtgtatgaccaacatcggccacttccgcgccgcctccaaacttttggaaggcaaggcagacacccccgtccgcctgtggattgcgccgccgaccaaaatggacgcgaaacaattgtccgacgaaggacactacggcgtactcggacgtgccggcgcgcgtatggaaatgccgggttgctccttatgtatgggtaatcaggcgcaagtacgcgaaggtgcgaccgttatgtccacctccacccgcaacttcccgaaccgtttgggtaaaaacacctttgtttacctcggttcggcggaattggcagcgatttgctccaaactgggtaaaatcccgaccgttgaagaatatcaagccaatatcggcatcatcaacgaacagggcgataaaatctaccgctatatgaacttcaacgaaatcgacagctacaacgaagtagccgagaccgtgaacgtttaatccccgtcatccgtatgaagtaagggattgaccgcaatgccgtctgaacaaccttcagacggcattgcaacattccgctaacccttctttccgcaaacgctgcaaatacggcgttcacgcccccacataaaggaaacgacagtgaacctgaaaaaccgccattttctgaaacttttagacttcacgccggaagaaatcaccgcctacctcgaccttgccgccgaattgaaagccgccaaaaaagcagggcgcgagattcagcggatgaaagggaaaaacatcgccctgatttttgaaaaaacctctactcggacgcgctgcgcgtttgaagtcgccgcgcgcgatcaaggcgcgggagtgacttatttagagccgtccgccagccaaatcgggcataaggaaagcatcaaagacaccgcccgcgtgttgggcaggatgtacgatgccatcgaatatcgcggtttcggtcaggaagttgttgaagaattggcgaaatacgcgggcgtacccgtgttcaacgggctgaccaacgagttccatcccacacaaatgcttgccgacgcactgactatgcgcgaacacagcggcaaacctttgaaccaaaccgcgtttgcctacgtcggcgacgcgcgttacaacatgggcaattccctgctgattttaggggcaaaattggggatggacgtgcgtatcggcgcaccgcaaagcctgtggccgtctgaaggcattattgccgccgcacacgccgccgccaaagaaaccggcgcaaaaattaccctgaccgaaaacgcgcatgaagccgtgaagaatgttgattttattcataccgatgtgtgggtcagcatgggcgagccgaaagaagtctggcaggaacgcatcgatttgctgaaagattaccgcgttacgcccgaactgatggcggcatcgggcaatccgcaagtcaaattcatgcactgcctgcccgccttccacaaccgcgaaaccaaagtcggcgaatggatttacgaaaccttcgggctgaacggtgtggaagttacagaagaaatattcgaaagccccgccagcatcgtgttcgatcaggcggaaaaccgtatgcacacgattaaagcggtaatggtcgcggctctgggcgactgacagaactgtgcctgtttaaattcatccgcaacacagataccgtctgaacacgatgttcagacggtatccatatatagtggattaaatttaaaccagtacggcgttgcctcgccttgccgtactatttgtactgtctgcggcttcgtcgccttgtcctgatttttgttaatccactataaaaaaactgcctacacgatgtgtaggtagtcccgtttgaaaacaatcagtttttgtcttggtcaaccaatttgttggcagtaatccaaggcatcatggcacgcagttgtgcgccgactttttcaacttggtggtcggcattcagacggcggcgggcagtcatagacgcatagttgacattaccctcttggataaacatttttgcgtattcgccggtttgaatgcgtttcagggcattgcgcatggcttctttgctggaagcattgaccacttcagggccggtaacgtattcgccgtactccgcattgttggaaatggagtagttcatattggcaataccgccttcgaaaatcaggtcaacgatcagtttcatttcgtgcagacattcgaagtaagccatttcaggcgcgtaaccggcttcggtcagggtttcaaaacccgccttgatcaactcgaccacgccgccgcacaatacggcttgttcgccgaacagatcggtttcggtttcttcgcggaaagtggtttcaatcacaccgcctttggtgccgccgttggcagccgcataagacagggcgatgtctttggctttgccggaattgtcttggtaaacggcaatcagagaaggcacgccgccgccgcgtttgtattcactgcgtacggtatggcccggacctttgggggcaaccataatcacgtccaagtcggcacgcggaacgatttggttgtagtgcacgttgaagccgtgtgcaaatgccagcgttgcgccttctttcaaattggctgtaacttcggcgtgatagacggcaggcatggtttcgtcaggcagcagcagcataacgacatcggcttctttggtcgcttcagcaacggttttgacgacatgaccggctgcttcggcttttttccaagaagaaccttggcgcagaccaatcaccacgtttacacccgaatctttcaggttggcggcatgggcatgaccttgcgaaccgtaaccgatgatggcaacggttttgcctttgattagggacagatcggcatctttatcgtaatagacttgcatttgatttcctttaaggtaaatggttgtcgaagccttaaaatgttgagcggcttcggacgggttaaacagagtgtgccgcttaatcggcaacttcattcatcaatacgatttccaacgcttcggttttgccgtcgacggactggacgaaggcttggaaatgcgcgctggcgttatgttcgtcaatagctgcttgagatttccaattttccacgaaaacaaaacggttcggtttgccgatttcctgatggagatcgtagctgatgttgccctcttctgcacggctggctttgaccagttctttaaactgtgctgccagtgtttctgtgtattccggtttgacggtaaccagtgcgacaattttaatgttcgacataaatctctcctgccgttcgtttttcagacgacattcaaataccgtgccgtctgaaaggttacggcgttaaattttcaaaatacgctcaccgcgaccgatgccggccgcgcctgtgcgtacggtttccaaaatttgggcgcgtccgaccgtttccaaaaaggaatccagcttgtctgtcgagccggtaatttcaatcgtatagctgcggtcggttacgtcgatgatgctgccccggtagatttcggtcaagcgtaaaaattcgtcgcggtctttgccggcggcacggacttttaccaacatcagttcgcgttcgacaaaacggctttcattcaaatcgaccactttaatcacttcaatcaatttattgagttgcttggtaatttgttcgatgacctgctcgtcgccgtgggtaacgatggtcatccgtgacagggttttgtcttcggtcggcgcaaccgccaaagaatcgatattgtaatcgcgtgcagagaacaaaccgaccacgcggctcatcgcacctgattcgttttcaatcagaacagataagatatgtcgcatttgtctctccttacgcctttccgtccgcacgcatatgcggcggaagtaccatttcgtccaaacctttgccgttgccgaccatgggcatcacattctgtttctggtcggtcaggaagtcgataaacaccagcctgtctttttggttcaatgcttccaacaacgcaccttccacatcagacttcttgtccacgcggataccgatatggccgtatgcctcggcaagtttgacgaaatcgggcaaagaatcgaaataggtttccgactctcgtccgccgtaatatatttcctgccactggcgtaccataccgagataaccgttgttcagcgtaatgacgttaaccggaatccgatattggaaacaggtggacagctcttggatgttcatctggatcgagccgtcgccggtgatacagaatacgtcttgatccggggcggcaagttttgcaccaatcgcataaggcagacccacgcccatcgtacccaaaccgccggaattgagccattggcgcggacgttcgaagggataatattgagccgcaaacatttgatgctgccctacatccgatgtgatgattgccgaattgccggtaatctcggcaagcttctgaatcacatattgtggcttgataatttcgctgccgttgtcaaaccacaagcaatctcgggaacgccattcctctatggttttccaccatttgcccaaagcatcttcagacggcacggactcttgtttttgccacagcgcaaccatctcggacaaaacgtttttcacgtcgccgacaatcggaatgtccaccttcacgcgtttggcgatgctggaaggatcgacatcgatatggataaccttcttcgccttctcgaaaaatttggacggtacggaaaccacacggtcgtcaaaacgcgcacctacggcaagaacgacatccgcattctgcatggcaaggtttgcctcgtaagtaccgtgcataccgagcataccgaggaattggcggtcgccggaaggataagcgcccaagcccatcagcgtacccgtgcacggagcacccgtcattcggacaaatcgggtcagctcttcagaagcattacccaacaccacgccgccgccaaaatagacgaccggacgtttggcagatgccaacatctgcacggcctttttaatctgaccgatatgtccttgaacaaccggttgatacgaacggataaaaatgtcttcctgaggatagctgaatttcgccatcgcctgcgtaacatctttcgggacatcaaccaccacgggccccggtcggccgcttgcggcaatttggaacgcctttttaatggtttccgccaactcattgatgtccgtaaccaggaaattgtgtttgacgcacggacgggtaatacccaccgtatcaacttcttggaacgcatccgtaccaatcagggaattgcctacctgcccgctgatgaccaccatcggaatcgaatccgtataggcagtagcaataccggtcagtgcattggtaacgcccgggccggatgtaaccaatgccacgcccaccttaccgctgacgcgcgcatacgcatctgccgcgtgtactgccgcctgctcatggcgggtaagaatgtgtttgaatttattgagttggaaaagggcatcgtagatttcgataaccgcaccgccgggataaccgaaaacgtactcgacaccttcggctttgagactctgcactatgatttgcgcgcctgataactgcataacgacctcttttatacggtttcaaaccaatagggacaaaccgctttgccacagcacctgtaatgcaattccaccaagcagcgatttagggtacgcgcattgggggaacacggcaacagacggattatccaatcaattggaaaggaacacagagtttgtgaaaaagagtagaaacgataacgcaaaccgacagttcaatcaagaaaaatctttcatcttttaatattttttgaaagcagagaaattattgattgattttaaaagaataaaatcaggagtaccttttttgaaagatggaaattgttgacagtttgtgtaggaggggcagatgtgaaaaacccttcttcgatatcaagaattgtaaaatttacagggtttcatcccaataaagactcgggatattgattgaacttgattttatttttgatatatcaaaaatattcccaaccatacttcctgaaaatggctcattgcaccggactgtattggacggcattgacagaaccaagagggctaacaacgacttaatatattgattgtatagtggattaacaaaaatcaggacaaggcgacgaagctgcagacagtacaaatagtacggaaccgattcacttggtgcttcagcaccttagagaatcgttctctttgagctaaggcgaggcaacgccgtactggtttaaatttaatccactatatttagttttatctatttcattaaacagcaatagacaaaaaaaataaccgctctaaaagcggttgtggtgcccagggtcggactcgaaccgacacaccttgcggcgggggattttgagtcccctgcgtctaccaatttcgccacctgggctggtgaagaagtcgtcattataatggcttttgaaattctgtaaaccttttttttgaaattattttatctgtttttattttatttttgattttaaatagaatttttattattttaatcttactgttctttccgctccaaagattctgtatgattcggcaattcctgccgtgcagacaacgtaaaaaaatactacattaaatctgccaaacgcgttaagatggaaatattcaaattccgtacgaatcaggttttgctatttattcttgggagattgtcatgttttccgtaccgcgttcctttttgccgggcgttttcgtacttgccgcgcttgccgcctgcaaacctcaagacaacagtgcggcgcaagtcgcttcttcaagtgcatccgcgtcggctgcggaaaatgcggcaaagccgcaaacgcgcggtacggatatgcgtaaggaagacatcggcggcgatttcacgctgaccgacggcgaaggcaagcctttcaacctgagcgatttgaaaggcaaggtcgtgattctgtctttcggctttacgcactgtcccgatgtctgcccgacagagcttttgacgtacagcgacacgttgaagcagttgggcgggcaggctaaggacgtgaaagtggtgttcgtcagcatcgatccggaacgcgacacgcctgaaatcatcggcaagtatgccaaacagttcaatccggactttatcggtctgacggcaacgggcggccaaaacctgccggtcatcaagcagcaataccgcgtggtttctgccaaagtcaatcaaaaagacgacagcgaaaactatttggtcgaccactcttccggtgcgtatctcatcgacaaaaacggtgaggttgccattttctcgccttacggaagcgagccggaaacgattgctgccgatgtaaggaccctgctctgataaaaccgtatgccgtctgcaccgtcggcgcctattcagacggcattattgtttcaaccgacaaaggacatccacaccatgcaggataatgctttgaccatcgccttatccaaggggcgcatttttgaggagacgctgccgctgcttgccgctgccggcattgttccgactgaagagcctgaaaaatcgcgcaagctgattatcgggacgaaccatgaaaacatccgccttgtcattgtccgcgcaaccgatgtgccgacttatgtccgctacggcgcggcggacttcggcattgcgggcaaagacgtgctgatcgaacacggcggcacggggctttaccggcctttggatttggagattgccaagtgccgcatgatggttgctgtgcgtaaagggtttgattacgaagcagcttcgcaacccggatgccgtctgaagattgccacaaagtatcctgaaatcgcggcatctcattttgccggcaagggtgtccatgtggacattatcaaactgtacggctcgatggaacttgcgccgctggtcggcttgagcgatgcgattgtggacttggtttcgacgggcaacaccttgaaggcaaacggcttggaagcagtcgaacacatcgtcgacatttccagccgcctggtggtcaacaaggctgctttgaaaacgaaatacgcgctgctggagccgattattcaggcgttcggcggcgcagtgaaggcgaagtaagcatccatttgaataaagatgcgttttcagacgaccctatccgttcccgccgacaggtcgtctgaaaatatcaccggcagtaaactgtataggagaagttaaaatggttgcaaaaataaaaaaattctcagattcaaccctttccgttttgaataacggcgagcgtcggttttatgtctattgtctgaccgacctgaaaaaagacaaaatcctctacatcggcaaaggctgcggtaatcgtatcttcgagcatgaatgggttgctagtcgttcacaagatccagtctccggcgagattatcgatcggaaactcaaagccatctccaaatgcaagaaactcggtcgctatatcatcagctatcatctgactgaagtcgaagcactcgccgccgaatctgccttaattcattttgttaaatctgtcttgggtaaaaaactcaaaaataaaattgccgggcatggtccgggtggtattagcgtagaagaactagatcgccgctttggattctcttctctcccacttaacgagattaaccccgacgggctgattctcgccatcaaaatccacaatgctttcgatttagatactgacgaagaattagactaccttttcgacaaccaagacgatgccaacctcaaatcgcgtacgttgggcaactgggttatcggtaaagatgttgcttcaaaagtgaaatacgttatcggcgttcacaccggtctgcaaaacgctgttgtcagtgcatacgaagtggacggttttgaaacaatggttgaggaaaccaaaaacggtagaaaacaatcccgttaccgtttccgcactacctctcgtagcgaagaggtattagccaaactcggtctgcaacaaaaatgcctgcccgaattgaagtttggtagcgggggagaaaaagcgtatatcagacccaaaacagagacagaaactgaacaagagaatattcagacgacccccaatccaaaaataaaaaaggaaaaaaccaaatcatgaaaaaactcaacacccaatcgcccgatttccaagccggactcaaagccctgctggcttttgaaaccgcgcaaaaccccgaaaccgaacgcatcgtcgccgacatttgcgccgacgtgcaaaagcgcggcgatgcggctttgattgaatacaccaacaaattcgatcagacaaacgctaaaagcatcgatgatttaatactcacgcaagccgatttgaacgcggcgttcgagcgcattccgaacgacgttcagacggcattgcagaccgccgcccgccgtgtcgaaagctaccaccaacgccaaaaaatggaatcgtggagctacaccgatgaagacggcacgctgttgggacaacaaatcacaccgcttgaccgcgtcggcatttacgtccccggcggcaaggcggcgtatccgagttccgtcatcatgaacgccatgcccgcccacgtcgcaggtgtgaaagaaatcatcatggtcgtgccgacaccaaaaggcgaacgcaacgacatcgtacttgccgccgcatacgtcgccggcgtaaccaaagtcttcaccgtcggcggcgcgcaggcggttgccgccctcgcctacggcacggaaaccatcccccaagtcgataaaatcaccggtccgggcaacgccttcgtcgccgccgccaaacgccgcgtgttcggcgtggtcggcatcgacatggtggcggggccgtctgaaatcctggtcatcgccgacggcacgacacctgccgattgggtggcgatggatttgttcagccaggccgaacacgacgaaattgcccaagccatcctcatcggcacgtcgcaagcgtatctcgacgaagtagaagccgctatggaccgcctgatcgaaactatgccgcgccgcgacatcatcgaagcctcgctcggcaacaggggcgcgatgatactcgccaaagacttggacgaagcctgcgaaatcgccaactacatttcccccgaacacttggaactgtcagtcgaaaacccgcaggaatgggcgaaaaaaatccgccacgccggtgcgattttcatgggacgctacaccggcgaaagcctcggcgactactgcgccggtccaaaccatgtgttgcccaccagccgaaccgcccgcttttcctcgcctttggggacatatgatttccaaaaacgctccagcctgattcaggtttcggaacagggcgcgcaaaaattaggcgaaaccgccagcgtgctggcacacggcgaaagcctgaccgcccacgcccgcgcggcagagttccgtatgaaataatgccgaaacggcgtacaggcatattccaaccattaaggaaacacgatgaaatccgtccgctccttcatccgcgacgacatacaagctatgtcggcatatcagattgccgacgttccgcccggctttgccaaactcgattcgatggaaagtcccgtccacccttttgccggacatgaaacgctgttgcaggaatggcaggcacggcttgccgccgcgcccatccatctttaccccaatccctccggcagcggtttacaggaagcattacgttcggcgttcgacattcccgactgcgccgacatcgcgctgggcaacggttcggacgaactgatacagttcatcacgatgctgaccgccaaaccgggcgcggcaatgttggcagccgaacccagtttcgtcatgtaccgccacaacgccgcgctgtacggcatggattatgtcggcgttccactgaacggagatttcaccctcaacctgcccgccgtcctcgaagccgtcaggaaacaccgccctgccctgacctttatcgcctaccccaacaaccccaccggcgtatgcttcacgcgtgccgaaatcgaagccgtcatcgaagcttcagacggcatcgtcgtcgtcgatgaagcctacggcgcattcaacggcgacagcttcctgccgcaggcaggcaggattcccaacctgatagtcttacgcaccctcagcaaaatcggttttgccggactgcgtatcggttatgcggcaggctgccccgaagtcatcggcgaactgcaaaaaatcctgccgccctacaatatgaaccaattgagcctgaccactgccaaactcgccctgcggcactacggcattatctctgccaacatcgacagcctgaaaaacgaacgcgaacggatgttcgccgaattgggcaaaatatgccgtctgaacaccttttcaagtcaggcaaacttcattaccatacgcgtacccgatgccgatttgttgtttgacacgctcaaacaaaaccgcatcttggttaaaaaactgcatggcgcgcacccgcttttggaacactgcctgcgcattaccgtaggcagccccgcacaaaacgatgccgttctcaacatcattcgccaactttactgccaaccaacggatttcctatgaatttgactaaaacacaacgccaactgcacaactttctgaccctcgcccaagaagcaggttcgctgtccaagctcgccaaactctgcggctaccgtacccccgtcgcactctacaaactcaaacaacgccttgaaaagcaggcagaagacccagatgcacgcggcatccgtcccagcctgttggcaaaactcgaag

SEQ ID NO: 37798 - DNA, 18974 bp, Neisseria meningitidis
ataagtcggacaaagttattgattgattctcttttttctggaatagaagaattaaacatgatatttggctaatctcattttctgataattcagaaatggtaattaaagaatccctgaaagatggtcataaaatatacaaatttgaattttgcgaaattgtcgataattgcaattttgatgatgtattcgtttgaagcgaatgcaaatgcagtaaaaatatctgaaactgtttcagttgataccggacaaggtgcgaaaattcataagtttgtacctaaaaatagtaaaacttattcatctgatttaataaaaacggtagatttaacacacatccctacgggcgcaaaagcccgaatcaacgccaaaataaccgccagcgtatcccgcgccggcgtattggcgggggtcggcaaacttgcccgcttaggcgcgaaattcagcacaagggcggttccctatgtcggaacagcccttttagcccacgacgtatacgaaactttcaaagaagacatacaggcacgaggctaccaatacgaccccgaaaccgacaaatttgcaaaggtctcaggctaagtgcgcctgttgccgcctaaaaggtaccccggatgcmtgattatcgggtatccggggaggattaagggggtatttgggtagaattagggagtgattggtagcggaaatagacgaaaacctgtgtttgggtttcggctgtcgggagggaaaggaattttgcaaaggtctcaattagtatagtggattaacaaaaatcaggacaaggcgacgaagccgcagacagtacaaatagtacggaaccgattcactcggtgcttcagcaccttagagaatcgttctctttgagctaaggcgagccaatgccgtactggtktttgttaatccactataaaatcgagtttatcctagctgtccaggacagcccctattttttcataaccatcacgaaaggaattttgcaaagattttattccatctcaaaacaatcatctcaaaaatgcgtttctgaccgccggtaaaacaaaaccctctaagaaaatacttagagggttttgaaatttggctccccgacctgggctcgaaccagggacctgcggattaacagtccgtcgctctaccgactgagctatcggggaacaagcgcgaataataaaacagaaataccgaacgtgtcaatataaattgacaatcgattgcactttatctgcaagcccgcaatctttatatgttatatggcttccgcaatatgccttgccgcacgtttggcatccaataggattaaaccaagtctgccggtttcttttgccaccagcaccaacacggcatctttacccgcctgacttaaaaggatatagcctgattttcctttaatcatcacttgttccaattccccgcaggcgagttcctgcaccgagcgactccccaaagcaagcaaagtggcagaaatcgcccctaccctgtccgaattcaaatgtgaaggaagcattgtcgccatcggcaatccgtcggttgagataacggcagacgcgataatatccgtagatgtattgtttaaatcttcaaggattgaaatcaataattgctgcataacccctcctctctcccaagttttacacgcggttgctgtaacggcggtataaaatccttaccaaagtaacaaatgcctctttgcccaaatcgggaatgccgccgataaccaaaataaatttggttgaaccgatatacaatgggaaaaatgtcaattcgctctgaccggaaggatcgcaaacgccccaagcgttattgttgatatacaggttgttcttaatcagcagccggtatttcttttccatctgtgcgacttctgccgccaacaaccccaactcttccgccgcctcatgatggaaattggcgttggcaagatacagaccgttccgatcgaccaataacgccttaccgctgccggacaattgttccatcagcaacggcaattgctcgtccgacaaattgatgccgtctgaatgaccgttttcatcgccatagaggaattcgagtttttgcaaacggtacaacaggttcaaagcggtatcgatgtcggcggtgtccgcccaagtaagcagcttctcactgctgaccatttcgtccgcatctgctttcaacaggctgtgcaacaaagttttaccggcactgggggcatcgctggatacggcataaaatgcaccggcaggagtcaggcggggatataaatttgcttgtagtgaaagtgttgattccatattaaacctccagtcccggatcaatagaaaataacattgcgctaaccaattgttttacgtcatcttccttacgggcatcaatttcaaaaaccggaacattaagattatgttttgcaagatatttgtgatacacgtcgataccgggctgagagcgtatatccatcttggtaataccgacaacgacgggtgccttctccagcagccctcgaaacgaatgtaaaaagaattccaaatctttcaacggattggttcgggcattatctaaaagcaagaccaaacccatactgccttggcttaagatttcccacataaagttgaaccgttcctgaccgggcgtaccatataaatggactttggtatcctcatccaagctgatggccccgtagtccatcgccactgtcgtattccttttcctatccaaagtcatatcggatgcggaagcatcggtctgaacgagtgcttcgtccgaaatagccgcaatggcagtggttttccctacgccgacaggtcctgtgaaaataattttattttctctcatctctccgcctcttagctgcccaacagttttttcatcagcctttgcagaaggccgcgcgactgggattgggatggtgttgtgattttttccgcttttttcatcatttcactatcagaggcagaatcggctccgatatttattttatccgccatatcggagtatgcctgttgtgaaaccgtttttaaatctaccgacaaaaacccggttgtataggttgccgcaagataattcagaatatcattgaggtttaaaggcatcactttatacaacacgttaaggttgacggatgccttggtcagaaatgccgacaagcgtatcgaccccggcacatttgccaaccgggtcaggtttggccaagatttcaacgtaaacggagtatcgggagaaatcggataaatcaacctgccctgcgctgtccaaatggaaaactgccacatacaggacataatgcctactttagccttttcgcgccattgcgggttatcgggaacagtcttgcagctgacctgcaaattttcgtctttgcacaattcttcgagtttttgcacactttctgtcagcaaaacccgttgtatcgaggggaaaacaataaggaccggcttatttccatgcaagatagcgatgtcctgcctgttcttttccgcaaaccgcaacgcccccaataatcctttattcgggttaaactggcgtatcgtaaccgtacgctgcacattcccgttatttttcgccgaccggtctgcgggtgcaataaacgatttcccataaacattctcgccctgcaacaatttgcggagcataggaaacaatgtttcaaaccgaatcggtttgggcaggtagggaacttcagaatcgggaactttctccgaacagacggcgacgggtatatccttataacgctcggcaagctctttccaaagttcaaaaccgccctcggcatcggtatccgccaaaaccaaatcgggcacggcactgccgtctgaaggggatactgtttcataacgggtggtattgtgcattttgaatgccattttgaaaacggattcctgctgcgccgtcatccccgccaacattacgcgtactgttttaattttcggcagttgaacttccatttttattttccgtaccgttttatttttttaatattttgattcatacgctgcagcagccggctcatcagcataacgacctcttcaggaagcctgtccgcacgttccctcaatacccttaaaaactgccccaacctatcccaatcttcagtacgttcataaatatcgatcaacgtaatataaagctgggactcgtcgggatatttcaataccgcctgctccaacacatccattgccgcttcaatctgaccatacatcagcaacgactctacttccttaaccgcatcgtctgccggagacgaaccggtgttaatcaacgaagaatcttgaagcaccaaatcccgatgttgcgatttgaatttctgtatatttttcggcagatacccgtgccccataccgatgtctttgatttgccggtcgttcggccctttttccaaatcatcgaaaacttcatggtaacccaagctgtacccccaccccagcatccgctctttaacctgcctgccgtagttgcccaacgtttggtaaagtttccacaaatgtccggcaaaacggtctatgtccgcgtgttggtaatcgagtttcaacgcatcgataatcaggtttgcaggtttttcggaagtttggatggcacggtcgtattgtttcgatgccgtttcatagctgactttgtctttaaggattttcgcaccttgatcggcacggaccaaaccggcaatcgcaccgatttcctcttgactgattccggacacgtcttttttgccccgcacaatcgggatgcgcttgatttcttcggcttcataagccttaccgccggcatccggcgggggcgatgcggaagctgccgtcgcagaaccgccttccgcacgtttttcaatctcctgagtaccccatcccaaaccttcttccgccaagacgcggatacgcaaatggtttgaatcgcgctgtaatgcctgttcgatatattttgccaaaagttcggaaagaatcagtttgccgtatttttgcagattgtctgccaaaacatcgacatcccccacttcgagattgatatcgagcagctcgcggataaggttttcaggtttcgcttcaccatccggaatgccgtccagataggcagccaaagattcggcagccttgccctgataaccgaattgcttataaacctgatactccgtaagcggatcgacttcttgcgcggatacggcggcggatgcggtctcggcactttcgttccaagaccagtcgggttgcgtgccgtctgaaaccgattgtccaatctgatcgacccagtccgaatcattgcttccgggtgtctgcccctgcgtattgccgacaccttgggatttgcgcttcggtgttttcttaccctgcttcgcacgcataaccaaaagcatcagcaataccgccagtgccaaaccgataattaatgagttttccaaaggatactcccgataccgtaacgagcggatagctgaccgcctgcaacggccattgtccgcttttattattaacgatttactgaaatagacttgtaagttttaaatcataccataatttaacgtttaacaatatgccttctgcacaagcctcgccatattaccttttacccacatcagtatcaatacccgatataaaaataactttgcccataagctgccttattgcctgcccgccgcagagtagcgcgcgataaaaaataacggatgataagtcaggcgcactttgcccgacggcataccgaacgccgacaagtaatcgccaataaatccattgagattttttcttgtccaatttttttggttcgtggctgttacgcctgtatatttaaggtgtttgagtacatctgacggcgtatcaaagtctagtattaccgtaaaatcctcacaccataaaagctcaaaatctttggctaaccaagcctgccattgggataaagtcgggtaatttaagcctatatttgtaatttggcggacttcttttaaattgtctttgccaaaggttgcaaccgccaataatccgtttgttttcaagcctgttttgcaatgggtgataaaagcgtcgggttgatgaaaccattgcacggcagatgcgcttgcgattaagtcaaattgtcgttgaaaaggaaagttttccgcatcgccgcaataaaaatcaaaggattgcggcagtttttcagccagttggggctgcacattgcacaaatcattaaataaccaataattcgctgaaatctgtttttgcagcaaggcactcaacattcctgagccgcagcccaattccaacacgttttccaatggcatatccggcaaataatcttgcaaatgcgtcattaaattaatcgtcattttttgttggattaaggcgtgccggtcataatcgtttaatgctttttggaaagcctgccgaatgcgcgatttatttatggcagtcagtgattccatagtgccgaccaatgggtgaatcttgaaaacaggtaatgtccgacgtcaatttcccgaacggtgcaacgcggtgtccaatatcggtgctgattggcaggcataaaaattttatcgcccgatccgaccaaggcatttgtccagcggataagatctgtacgtctatcttgcccgatcatcgcaaaaagtgcgataagttcttgatgaatttcgccaaacgggcgtgcgggaaattgttggtaatcttcaaaagatgctttatcgccacacattctgcgttcaaattttaaacgggtgttttccgtgaggttctccaatgtgcctttaaaaacggtgcaagggataccgaaattatcatcgcaaggcaaacctgtgccattcactgccgttgcggattttaatcttattccttgcaatgccctctctgccgcccaaacgcccattgaccacgccaccaaacggatgtgccgataggcggaaaaatcaaaatccaaatttaaatcttgataatcatagcaaatcaataaatcgtgattttccggcaaaatcaaatgatttacagcatcgggcggcgttccccaacctgcaaaatacaggattaaatgtccgccttgatgattgtaaaattttgtttccatatcatatccttacaggcacgccgcaaactgccgcacttcatccgttgtcatatctgccgttaaagacaggcggattctggatgtgtttttgggtactgtcgacggtctgatgggcaggcaataataaccctgcctttgcaggtattccgctttggcaagggtggcttcattcccgcctaaaatataggggacgatacaggtttggctcggcattatttgcgtccgatgcgccacttcccgccgtaaaaatgcgcttaactgctcaagatggcttctttcttttgagaattgcggcaatcgttcaaaaataaaataagtccaagccacattaaacggcggcaatgcggttgaaaaaatcaatgggcgcatttgattaatcaaacattctttcaatacttggttgcagacggcatacgcccccaccgaggctaaggctttaccgaaagtgccaaccaataaatcaatctcggcaatcaaattatcccgttcggcaatccccaatccgttttgcccataaacaccgattgcgtgggcttcatccacataaagataagtattgggaaactgtttttttaattggacaagctgtttcaaatccgccacatcgccgtccatactgaaaacagattcggtaacgataaaagtgcggtcaaattttccgacgtttttttcaagcagatttttcaaatgttcataatcattatgacgataacggaaaaacgcacaccggctcaaacggatgccgtcaatcatactggcgtgaacaaatttatctgccaaaatcaaacttttcgtcgtcgtcaaagcaggcaaaataccgagattggcgtgatagccgctgttgaacaataacgcgctttcccgttggaaacgttgtgcgacaagctcttccaaatcggtataaataggaaagttgcccgttaataaacgcgatgaagaactggtaaaagagggaaaattaccgccgtattgctgcaaaaaagaccggcgcaagttttcatctgatgccaaacccaaataatcattagacgacatattcagcattttgcggttttcccgcgtaatataccgcccttgatgaatcaaatccggaatcgaacgatattggttttgcgcgccgagttgttcaagctgttgtttaaaaaccttcattatgatgtaaatattcctgagttaaagcctgaaccaacccagcatcaaacaatcaagtaatgcccttttaataaaaaccgttttgccgccgacctttgccacacccctgccttcataatccaaggcggaaatttccgcgacatttgtttccgttgccattacccaatccgtccgcactgtaccgaagcgcatattttcgcacaaattggtacggtttcaggtatgatttgccgaaaacctatcggacacacaccatattttgatatgaataaaacaatctgccgcactgctgcactattgataagcggtttttcatacgcaaacaccatcattcccgatgtctcccccgtcgcacaaggtcaacatgtcttcattaacatccctcagcaacgcctgttcctctacaccgacggcaaactgaccaaggtttatcccgttgcagtaggtcgggcgatgacgcaaaccaatctaggcgaacataaaatcggtgcgaaagcctataaccctgtttggtacatccccaaatccatacagaaagaacgcggcgacggcgtaaaaaccatagccgccggcccggacaaccctttggggccggtttttgtccgcttaggcgaccccaaactcggtttgggcatacacgggaccaatgcgccggccagcgtccccggggttcggagtcacggctgcgtccgcatgaaatcgcccgacgcgctcgagtttgccaaaaccatcgccagcggctcgcccgcctccgtcatctatcaaatggcgggtctcaatgaagatgcggatcgcaacctgtggcttgccgccttccgcgacccttacggtaagaacaaccttgacatcgcctctctgaaaaaaagtattgcgcaatgggcaaaaacacagggtaaaaccatcgcgcccgagaaagtcgatgctgtactcaaagaccgcaccggatcggccgtctgcctgacctgcggcaaaaacggcaagatgaagatgccgctcaaatcgctggcgtggatacagggttcttcctcatacagccaagctgaagtcattgaacaaactgaggaaaccaactctgccgaaatatccgagacacgcacgcccgaagtgcctgatgtacacacgcccgaggcacaaccgcatttaaatacccaatccgacggcacgccgactgcctataccgaaccggctgccgattcatcgccgcaagtagaaacacctgatcaggctgcttccgagccggttgatgtattattttcaatagatgtgatacggcagggaaatttgcgtttaggtaattgaataaccttctgattatttaatgcttatgtttatcagaagttgataggcggtttggtttttgtttggcttttcctacaccgccgcctgccgctttctgcaacattcaagcgcacaaatatgccatctgaaggctttagacggcatatttcacgataatagtcgcccaatcaaataaacacagattggaaatttattttatttttcccttaccaataccccagaactttccaccaaatgctgccgataacgaaaaaaatcagaaaattgactacgctcatgataaaacccgccttccaccattctcccattgtggtgtagcccgaaccgaaaatcacaggcgaagtaccggtcgcataatgagtgagggtcatcataatgttggatgcggccgccatcatcagcgcggtcggcatcgccggggcattcagtgaaacggcagcagcgaaaaatgcgccgaacatagcggtaatatgtgcagtagtactggcaaacatataatgcgcatacatataagcaagcacgaggattacgcccgcagccgtgccgctaacgcccaaaccgccgacactttccgccaacactccggagaaccatttaatcagtccgagtttatttaaaaatgcggccatcataatcaatgcgccaaaccaaataatcgtatcccacgcgcttttttctttcaaaacatcgtcccaagtcaatacaccggaaagcaaaagcaggcttaatccgataaatgcggtggcggtggcgttgatactaaaagcgtgattgccggtaataagggcgggaacatctgcccacaacagcagcaagataccgaaaatgaccgccataatgatttcgtctgccgacattttacccatctccctcagacggtctttggcaaattgaacggcattgggcgtttctttaatttcaggcggatacaaaaaatataaaatcaaaggcataacgaaaaaggcgataacgccgggaacagccattgcccacgcccacgccccccaagaaagacggaaactactgcctaaattttcggcaatcaagttgacgattaaagggttgggggcagttgcagtaataaacatagccgacgaaatgggattggaatgatagttgaccaaagccaaatatttacccatcttgccttctgtgccttttgcgggattggagccgtaactgccggcaatcgactgcataatcggatgtataatgccgccgccgcgcgcggtattggaaggggtaacgggagccagcagcagttcggaaagagcgagactgtaaccgatgcccagcgtttttcttccaaaaacggcgataaacaaatatccgatacgcatccccagccctgttttgagcaaaccgcgcgaaatcataactgcgatggcaatcagccaaatcaacggattggcgaacgcactcaacgcatcgctcatcgccgcgcccggtttgtcggcggttacgccggttactgcgaccaacccgacggcaataatcgacagcgcgcccaacggcatggccttgccgataatggcggcaatcacaccgacaaacatggccagcagcgtccaagcctgaggcttgaccccgtcgggtacgggcagtgccaaaaccagggcgcacaatactgcggcaatggcgaggggtatcggtttgaaacccaatttcatcatattgacctccgtaaaaaagaccgtcccgaaaaatcggaaaaataatatttaactaattgttttataagatatattctgatatttcaccgtctttccgatatgcggctccgggcaacttttgtttcagtatttgaattttcattagactgaatacgccgtttgaacggcacggcgaaaacccgggggatgccggacgttcagtcctttttcgcaccttgaaggtaaagcatttccaaggcaattgtggcaccggccaaagcggtaatgtcggattggtcgtaagagggggcaacttctacaacatccataccgacgatgtcgagatccgtcagcccacgtaggatttttaatgccctgtcgctgctcaagccgccgcatacgggcgtaccggtcccaggggcgaacgacgggtccaggcagtctatgtcgaaagtcaggtaaacgggcatattgccgacggtttctttgattttacggacggtctcttcaacactgtcttcattgactttaggggcggacaacacagtaaaaggcaattttttactgtgttcggtgcgtatgccgatttgtacggaacgggacgggtcgatgaggccttccttgggggcggtatagaacatcgtaccgtggtcgtattcgctgccgttgtcgtaggtgtcggtgtgcgcgtcaaaatgaatcagtgcgagtttgccgaaatagcgggcgtgggcgcgcaacaacggtagggtaatgaaatggtcgccgcccaaactcaaacagcgtttgccggaagaaagtaatttgccggcgtgcgcttccattttttcgacaaaatccctgctgtcgccaaaagaaaaaaccaagtcgccgcaatcaataatgttcaggcgttcgcgcacatcaaatgtccatggaaacctgcggtgctcccaagcgaggttgacggaggcgcgccggatggcttcaggaccgaaacgcgcgccggaacgccctgaaaccgccatatcataaggcacgccggtaataacccaatcggcatgactttcatacggcataaaattaagcggcaggcgcaaaaacccgaaattattggaaacgagggagttgtcggtttgtcctgccagtgtgctgtattgcatcgtaatgattccttgtaattggtttcaatcggtcgtgatgattggtgtttgagtaagaaaatcgggcttcagacgacatatccgatgccttgatgcgtctattcgtcttccaaataggtataaccattaagccccgcttcgagttcttttaagaaagacatagcctgcgaggcaggaaggtctgaatgttcgatttgttcgcgatagcgtttcatcagctctttcggatcttgataaacgtattcgagcatatcggcaacggtgtttccttcatcgtaatcgatgacggtaaattgtccgtcttcccctacaacaacatcggcagtggcagtgtcgccgaaaagattgtgcatattgccgagtatttcctgatatgctcccaccataaaaaagcctaaaagcggcggctcttcttcgggataatcaggcataggcatcgtaccggcgatgccgtctccgtcgatgtagtggtcaatcgtaccgtctgaatcgcaggtaatgtccaacaacacggcgcggcgcgcaatcggttcattcaaaccggtaatgggacaaacagggaaaagttgatctatgccccaagcatcgggcaaagattggaagagtgagaaattgacatacagcttatcggcaaaacgttcttgcaattcgtcaataatggttcggtgagaccggtgtttttcattaaacaattcgccgacttcatgacagatatttaaatacagttgctccgcccacgcacgttgcgccaaactcaacagcccgacattatactgattatgcacatcagcaagatcaaactgcccttcgtgtatccagctgcgtaaggaacgtttttcccgcgaggcggaaatatccgtccaagtttcccacatactgtgcaacacacgcggtgcttcgggcgatggcgcatccagccggcgcggtttgtaacgttcaacgcctataacattagcaaccaaaacggcgtgatgtgcggtaatgccgcgcccgctctcggtgatgattgtcggatgcggcagcccgtgttcgagacaagcctgactgatgccccatacgactgtggcggcatattcgttgaggctgtaattaacggaacaatccgattgtgtgcggtttccttcgtaatccacgccaagcccgccgcctacatcaaaacagcggatatttacccccagtttgtgcaactcaacataaaaccgagccgattcgtgtacacctgtggcaacatcacggatgttcccaagctgcgagcccaaatggaaatgcaaaagctgcaggcaatccagcctgtttttttgtttcaaaatatcgaccagttgcaaaacttgggaagccgacaagccgaattttgatttttccccacccgaagactgccattttcccgaaccttgggaagccagtctggcgcgcacacccaaacggggcttgatgccgagtttttccgcctcttccaataccatttgtatttcggacagcttctcaatcaccaaataaacctgatgccccagtttttcgcccatcaaggcgaaacggatatattcacggtctttatagccgttgcagacgattaatgtttgccggttgccggcgtgtgccaaaaccgccatcagttcggctttagaaccagcttccaaaccatgcggttgtccgcttgacataagcgattcgatgacgcggcggtgttggttgaccttgatagggtaaaccaaacaataaccgcccttatagccgcactcttcccgtgccgtctgaaaggcgcggttaatgtcgcggaggcggtgttcgaggatttgcggaaaacaaaacaaaacaggcaggcgcgcctgatgtttttgttgcacggcttcagtcagtttttgcagtgaaacagtttgattgtgttgcgagggattggggcggacgatgatttcgccggaatcgtcaacatcataataacctatgccccaatgattaatgttgcacacttcacggatggtaaggataggcataataaacctgctccgtctgtcgtgttgaaaaggaatgattataacaaatcagcgtgaaatgtcatttttttaataagaaaagcctgcctcatacctgatgaggaacaggcaaaatgccgtctgaacgcttcagacggcattttggttcatctttccatcaaaggagtcagcgatcgagctgctctttgatgattttcaggtcggggtaagacaacacgatgtcgtattcgcggccgtctttataggcttccacttccagcacaggcttaccccaatggtcgtcggcatcgacatcgtaaacctgataaccgcgctgctccaacattttcacagcttttgtgcggttttgttcaaaatggggatcgccgtaaatctgacgctcggcagagtcgccggcaaatgcggcagcggcactcagagaaacaacggcagccaataacagttttttcattttcagtcctttttttatcggttgattgaacaagatgtgtttttcaataccgccattaaaacacagcaaaattaggtttgaattagagggaagtcaagaagcgtaaatgccgtctgaaaaaaacagagccgtcaaacggctccgttttccttatacttctttagtttcggttgccttctggcgcaaacgcaaacttaattcacgcaactgcttgtcgtccacgctgttgggcgcgttggtcagcaggcattgggcgcgttgtgttttcgggaaggcaatcacgtcgcggatggattcggcaccggtcatcagcgttaccagacggtcgaggccgaatgcaagaccgccgtgaggaggtgcgccgaatttcaggttgtccaagaggaagccgaatttctcttgttgctcttcagggctgattttcagcgcggcaaacactttctcttgtacgtctgcgcggtgaatacggatagagccgccgccgatttcccagccgttcaataccatatcgtaggcgcgtgccaaacaatttgccgggtcggaaaccatcaggtcttcatgaccttcttttggcgcggtaaacggatggtgtacggcaacgtagcggtcggcttcttcgtcgtattcgaacattgggaaatcaacgacccacaaaggtttccattcgtctgtgaaatagccgttgtctttgccgtgctccaagccgactttgatacgcagtgcgccgatggcttcgttcacgactttggctttgtctgcgccgaagaagatgatgtcgccgttttgcgcgccggtacgcgcgataatttctttcagggcgttttcggacaggtatttcacgattggagattgcaggccgctgtcttcgccgttggaaaggttgctgacatcgtttactttgatgtatgccagacctttcgcgccgtagatgccgacaaatttggtgtattcgtcgatttctttgcggctgaattctgcgccgttcggcacgcgcagagcgaccacgcggccgcctttcatgtcggctgcgccacggaagactttgaattcttccgttttcatcaggtcggtcaactcggtaaatttcaagttgatgcgcatatccggtttgtcagagccgtagtagaacatggcttcagagtaaggcatgcgtgggaagtcgcccaaatctacatttaaagcatctttgaagacttgtttggccatgccttcagtgatgtccatgatttcatcctcgtttaagaacgaggtttccaagtcgatttgggtaaattcgggctggcggtcggcacgcaggtcttcgtcgcggaagcacttggtgatttggtagtaacggtcgaaacccgccaccatcaacagttgtttgaataattgcggcgattgcggtagcgcgaaaaactcgcccggatgaacgcggctcggcacgaggtagtcgcgcgcgccttcaggcgtggagcgggtcagcatcggggtttcaatgtcgatgaaaccttgcgcgtccaagtagcggcgaacgcccatagcaacttggtaacgcaggcgcaggttgcgttgcatcaccggacggcgcaagtcgataacgcggttggtcaggcgaacgttttcgctgatgttttcatcgtcgatttggaacggcggcgtggcggcggcgttcaagacttcgatttctttggcaaggatttcgattttgccggaaatcattttatcgttggtcgtgccttcgggacggttgcgtacgcggccggtaatgctcaaaacgtattcgttgcgggaggaatcggcagcggcaaacgcttcgggcgtgtcgggatcgatcacgacttggacgatgccttcgcggtcgcgcaggtcgataaaaatcacaccgccgtggtcgcgtcgacggtgtacccagcctttgacggtaacggtttggtctaagtattgctcactgatcaggccgcaatagttggtacgcataaaatcaccttttattgatttaaactgaaaacagaaaatgccgtctgaacggcggctttattgttgttcgggcaaatccgccttttcagacggcataggtcctgccaatgttttgacgggcaggtcgtcagggatgaccatacccagcgaaatcacatatttcaatgcttcgtccacgctcatatcgagttcgcgcacatcgcttttctttaccataatatagtaaccgccggtcggattcggcgtggtcggaacatacacggaaagataatcgccgtccttcggcaatgcggccttaaccgcattcgacacctgccctgacacgaaagcaatcgtccaaataccgggctggggaaacggcacgagtaccggcgttttaaacgaacggctgctgtcggacagcagcgattcggatacttttttcacactcgaatagatggatttcacaaccggaatccgccccaacaggctgtcccacgcggcgaggatctgccgacccaatacgttggcggcaaacaatccggttacaaacaatacggcaatggcaacgataacgcccagccccgggatattaaaccccaaaacatattgcggccgccattgcttcggcagcaggttgacgagctgatcggacgcggaaacgatataggaaaccacccaaaccgttaccgcaatcggcagccagaccaaaatgcccgtaatcagatatttttttaacgcyttggcagctttgccgccttcggccgcaggttccgtcatcttgcttgattccgacaaagtccgtacaaaccgcacattatacgcgtttgcccggattcaaacgaaatttttatcccgccccgccaaaccgccggcggcttcagacggcacggcaacttgatataccgtctgaacacgcggttcagatgccgtccaagtcgttgaacatcaacccgataccgataccgttctgcttgtggttgtagtcgatcaggctctcgccgtaaccgtggaatccgcgtaccacgcctttgagtttgcccttaatcggaaacgtgtaggcggcttcaatcgcgccgtagcccgttttggggttgtagcgcaatacggaatacacattctgcctgtcgttcaggcggtactgcagcttcacgtcgccataccccatatagtcggcaatatcgggattgtcgtttttatcgccgctctgatcgaacgcacgcacccacacgcgcggaatcaccgtcaatttgccccattccatgcctgccatggcgtaaatcctgttccacgaacgcgattcgggacggctctgtccgttggactggtggacaaaacccgcaccgagcatacgcagcctgccgccgaacggcaaatccgccttcacaggctgggtcaggaaaatttcaggtttgtaatccgtattgcggaacggcgcggatttcctgccttggttgtaaatctgccaatcggatctttgggtgtagccgaaccacagatccgcgcgggttttaaacaaatcttcggcaattttgcttttgaacgaaacctgcaatttggtttccgcacgtttctgctgtccgaatttttcctgtacagtcgtaccgcgcgtcggcgaacccggggcatagttgggcgaattgttgtaccagagcggcataaggtacatcggattgtgttcgcgtacgcccaacagcccgcgcaaatcgtttttgtccaagtcgtacatcaggctcaaaggcgtatagatgtcggcggtttcgcccgcactgtcggcaggaagcgcatccccgcctttttcaacaacaatgaccgcctcgcccttatccaggctgctgcggacggtttccgtcagattgagtacggctttcgactcctgcccttcctgccctgccgaagacggaagctgtgccgcaaaaatcctgtcgtaacacgccaaacgcgtaacattgtccgtcaaagcggcgcattgcagcgcggtctctccaaaagcggatgccatcggcaacagtcctgtcaaaagaatatagcgcatattccgtgtattcatctccgcccccattgtcggcatattggttttcaaacggcattttatagcggattcggataaaaaatcgcaccctttccgccatttcgggattttgcccccgcaatacagaaaaccccgaaaccgtcgggcttcagggttttccgcttatcgcgtatcaaccgccttggcggttttgcaaaaatcaagccaaggcttttacttttgcagacagacggcttttgtggcgtgccgctttgtttttgtggaacacgcccttgtcggcgatgcggtcgatgactttgacggactcttggtaaaccgcttgtgcgg

SEQ ID NO: 37799 - DNA, 28730 bp, Neisseria meningitidis
caaatggtcgtcattcatataatcgtcttccggcccgctccaattcaaaatatcttgttctgtcagctttgccataatgtatatcctctcggttcaccgcaaaaaacaaagcaccacaaagtggctttattcctttgatttttataaggcttattgcctaaggcgtttttgaaaacgcgcatcataacacgttttggattggtttttttattttctttacattattgatattgccgttccatttcctgcgaacggcgcacacaggcacaaacgccctcgcttatggcttcggcgacacgatgccgcctgaaagcttccacggcttcgtgggttgtcccgccttttgacgttacatttttttgaagcttctcgaaatcttcacccgtctgctcggcaagggcaaccgctcctttaaacgttgccagactgagcgcgcgtgcttctgccatatcaaacccttgtcggatggcggcattttgcaatgcgtccagcagataaaacacataagccggtccgctgccgctgatgccggtaatgccgtgcattttttcctcatcatccaaccaaacagtcaaaccgactgatttcatgattcgatcggcaatcctgcggtctgtttccgatacttccgcttcggcatacataccagatacgcccagcccgatttttccgggtgtattcggcataacccggacaatgcggcgtgttcccccgaggtaacggctgagcgtaccgaccgacaatccggctgcgacagaaagcaccaatgcgccgttggtgcggatatttttgcacgcagcttccatatcctgcggtttgacggcaaggattaaaacatcgtcggaatgaagctccggcagggttgccgaagtttcgacccccaactctttttccaaacgttcgcgtttttccgcaccccgattggctatatagatgcggtaaccgccttgtttgaccaatccgcccgcaacggcagccgccatattgccgccgccgagaaaataaacattcattatttctaccctattcaaaattaccttactaaattcattcccaattttttaccatcggacgcgctcggacagaccgttgcgccgcaacccctgcttttccaagcagtcaaatcctccctgtttgaacgtctcaatcaaaggtttgccgtcacgcgtacgccaatccagcccgcaggcttcaaacttccctattttcctgtaaaagtaagattgttgtgcggattcatattcgtttgccctgacggaacgattgccgtctgaaagcggtatctcgtagtcccctaaagacggcggactctcgccgccaatatcccaaaaatcgatggcagccggttttctcggcttacaccagccggtgagggacgaacactcataccaccccgccagccggcagcctgcaaccgtaaatgcaagcaacgcagccattgccgtatattttattgcccgaatttccatcagccccttttcccgaaaatcgcgctgccgatacggacgtgtgtcgcaccgcactcaatggcggcaggcatatcgtccgacatccccatagacagcacgtctgccttaacgccagccgcattgaggtcggcaagcagtttccgcatcgtttgaaattgcaccttcaactccgtttcactgctgttggctttggcaacacacatcagtccacgtacgacgatattcggcagcttcgccacttccacagcaagcgcgactgcttcttcgggcgcgacaccgtgcttcaccgcctcgcccgcaatgttcacctcgatacacacctgcaaaggcggcattgaggaaggacgttgcccgctcagccggacggcggttttcagacggcatacggtatgcacccaatgcgcgcgttcggcgacaaacttggttttgttggactgcacatcgccgatgacgtgccacacgatgtcggtcaaatccgccaactcttccgttttgccgtaccactcctgaatatagttctcgccgaaatcacgctgtccggcggcgtaaacttcgcggatgccgtctgaagggaaagtcttaccgacggcaatcaggctgacggaatgcggctccctgcccgcctgcagaaccaattttccgatacggtcggacacctcacaataacgttcttgcaacaccgtcatagattatcccctaattaaaaatgattaaacagttgaaacccctccagtcagggcggtacaatcaaggttgttagaaccattccaaccaatcgaaacattatactaaacagagccgcattatgcagattaccgacttactcgccttcggcgctaaaaacaaagcatccgaccttcacctgagttcgggcatatcccctatgattcgggttcacggcgatatgcggcgcatcaaccttcccgaaatgagcgcggaagaggtcggtaatatggtaacttcggtgatgaacgaccaccagcggaaaatctaccagcaaaacttggaagtcgacttctcgttcgaactgcccaacgtcgcccgattccgcgtcaacgccttcaacatcggccgcggtcccgccgccgtattccgcaccattcccagcaccgtcttatcgctggaagaattgaaagccccgagcattttccaaaaaatcgcagaatcgccgcgcggcatggttttggttaccggccctaccggttcgggcaaatcgaccacgcttgccgcgatgatcaactacatcaacgaaacccagccggcacacatcctgaccatcgaagacccgattgaattcgtccaccaaagcaaaaaatccctgattaaccagcgcgagctgcaccagcacaccctcagcttcgccaacgcgctgcgttccgcattgcgcgaagaccccgacgttatccttgtcggcgagatgcgcgacccagaaaccatcggcttggcactgaccgccgccgaaaccggacacttggttttcggcacgctgcacacgaccggcgcagcaaaaaccgtcgaccgtattgtggacgtattcccggcgggagaaaaagaaatggtgcgctctatgctgtccgaatcgctgaccgccgtcatctcccaaaacctgctgaaaacgcacgacggcaacggccgtgtcgcctcgcacgaaatcctgattgccaaccccgccgtccgcaacctcatccgcgaaaacaaaatcacgcagattaactccgtcctgcaaaccgggcaggcgagcggtatgcagacaatggaccaatcgctgcaatcgctggtgcgccaagggctgatcgcaccggaagtcgcacgcagacgcgcgcaaaacagcgaaagtatgagtttctgacacacaaccgctttccggccataccggcgggaaaacaaggcgcaaacacgcggggcgggacgcagcatcccgcccggctacctttccgaacaagaagcgtccgccttcctgttgaaacctgccgccgcaaactgcaaggcttaaaccgaaaagaagctaacgatgaataccgataacctgcacgacatcttggacgaaatggttcaagtgtattctcaaaaaaaacaaagccgatccgaaaccccggccgaaatcggcgcacacttccacccgctgctcgaccgcctgtgcgaaaccgcagaagcacaaaacgcgtccgacatccttatcagcaaaggattcccgccctcgttgaaaatcaacagcgcattaaccccgcagccgcaaaaggcgctgacgggcgaggaaaccgccgccatcgccgcatcgacgatgaacgccgaacaatcggaaatattccggcgcgacggcgaaatcaactactccgtccagtcgcgcagcggcacgcgctaccgcgccaacgcctaccacagccaaggcagcgcaggtttggttttgcggcgcatcaaccacgtcatcccgcaaatgcaggaattgggcctgcccgaaaaactcaaagacctcgccgtcgcaccgcgcgggctgctgattatcgtcgggcctaccggttcgggcaaatccaccacgatggcgactatgctcgaacaccgcaacaaaaccctgcccagccatatcgttaccatcgaagacccgattgaatttatctacaaaccgcgccgctgcatctttacccagcgcgaaatcggcgtcgacaccataaactggcagacggcggtacaaaacgctatgcgccaatcccccgacgtggtctgcatcggcgaagtccgcagcagggaaagtatggaatacgcgatgcagctcgcccaaaccggccacctgtgcatttttacgctccacgccaacaccgcgccgcagtcgctcgaacgcatactcaacttctaccccaaagaacagcacaaccaaatactgatcgacatcgccctcaacctgaccggcatcatctgccaacgcctcgccctcaaacaagacaaaacgggcaggacggcggttgtcgacttgctcatcaacacgcccgccatccaagacttcatcctgaagggcgacctgatgaacatcagtaaaatcatggaaaccgccaaaaccgacggaatgcagacgatggatcaaaaccttttcgaactgtaccgtcacggcatcatcagttacgaagaagccctgcgccagtccgtttccgccaacaacctgcgattgcacatccaactgcacaaagaaggcaaaacgcccgaactcctttacgacagggtcaacggtctcaacctcatttcctgatccgcaaaacccaatgccgtctgaaaaccgcatccccgttttcagacggcatgattttatccgccccattcatgtgctacactttatagtggattaaatttatagtggattaacaaaaatcaggacaaggcgacgaagccgcagacagcacaaatagtacggaaccgattcacttggtgcttgagcaccttagagaatcgttctctttcagctaaggcgaggcaacgccgtactggtttttgttaatccactatattcacttcataacaataaaccggtaaaaccatgaaaaccccactcctcaagcctctgctcattacctcgcttcccgttttcgccagtgtttttaccgccgcctccatcgtctggcagctaggcgaacccaagctcgccatgcccttcgtactcggcatcatcgccggcggccttgtcgatttggacaaccgcctgaccggacggctgaaaaacatcatcaccaccgtcgccctgttcaccctctcctcgctcacggcacaaagcaccctcggcacagggctgcccttcatcctcgccatgaccctgatgaccttcggcttcaccattttaggcgcggtcgggctcaaataccgcaccttcgccttcggtgcactcgccgtcgccacctacaccacacttacctacacccccgaaacctactggctgaccaaccccttcatgattttatgcggcaccgtactgtacagcaccgccatcctcctgttccaaatcgtcctgccccaccgccccgtccaagaaagcgtcgccaacgcctacgacgcactcggcggctacctcgaagccaaagccgacttcttcgaccccgatgaggcagcctggataggcaaccgccacatcgacctcgccatgagcaacaccggcgtcatcaccgccttcaaccaatgccgttccgccctgttttaccgccttcgcggcaaacaccgccacccgcgcaccgccaaaatgctgcgttactactttgccgcccaagacatacacgaacgcatcagctccgcccacgtcgattatcaggaaatgtccgaaaaattcaaaaacaccgacatcatcttccgcatccaccgcctgctcgaaatgcagggacaagcctgccgcaacaccgcccaagccctgcgcgcaagcaaagactacgtttacagcaaacgcctcggccgcgccatcgaaggctgccgccaatcgctgcgcctcctttcagacagcaacgacagtcccgacatccgccacctgcgccgccttctcgacaacctcggcagcgtcgaccagcagttccgccaactccagcacaacggcctgcaggcagaaaacgaccgcatgggcgacacccgcatcgccgccctcgaaaccagcagcctcaaaaacacctggcaggcaatccgtccgcagctaaacctcgaatcaggcgtattccgccatgccgtccgcctgtccctcgtcgttgccgccgcctgcaccatcgtcgaagccctcaacctcaacctcggctactggatactactgaccgcccttttcgtctgccaacccaactacaccgccaccaaaagccgcgtccgccagcgcatcgccggcaccgtactcggcgtaatcgtcggctcgctcgtcccctacttcaccccgtctgtcgaaaccaaactctggattgtcatcgccagtaccaccctctttttcatgacccgcacctacaaatacagtttctccaccttcttcattaccattcaagccctgaccagcctctccctcgcaggtttggacgtatacgccgccatgcccgtacgcatcatcgacaccattatcggcgcatcccttgcctgggcggcagtcagctacctgtggccagactggaaatacctcacgctcgaacgcaccgccgcccttgccgtatgcagcaacggtgcctatctcgaaaaaatcaccgaacgcctcaaaagcggcgaaaccggcgacgacgtcgaataccgcgccacccgccgccgcgcccacgaacacaccgccgccctcagcagcaccctttccgacatgagcagcgaacccgcaaaattcgccgacagcctgcaacccggctttaccctgctcaaaaccggctacgccctgaccggctacatctccgccctcggcgcataccgcagcgaaatgcacgaagaatgcagccccgactttaccgcacagttccacctcgccgccgaacacaccgcccacatcttccaacacctgcccgaaaccgaacccgacgactttcagacagcactggatacactgcgcggcgaactcgacaccctccgcacccacagcagcggaacacaaagccacatcctcctccaacagctccaactcatcgcccgacagctcgaaccctactaccgcgcctaccgccaaattccgcacaggcagccccaaaatgcagcctgaaaaagtttcggcattttgtaagagaggacagattgtcagacaggttacaagatagtggataaagctttgcgcagggtaaatgcgtagcaactgaaccgtcattcccacgaacctacatcccgtcattcccacgaaaacagaaaaccaaaaacagaaacctaaaatcccgtcatttccacgacaatgggaatccagttcgttcggtttcgcttgttttaagtttcgggtaacttccacttcgtcattcccgcgcaggcgggaatccagtgcgttgagcttcagctatttagaataaattttgaaactctaatcccgtcattcccacgaaagtgggaatccagttttttgagtttcagtcattcccgataaattgccttagcattgaatgtctagattcccgcctgcgcgggaatgacgaatccatccgtacggaaacctgcatcccgtcattcccacgaaagtgggaatccggttcgttcggtttcacttgttttaagtttcgggtaacttccacttcgtcattcccgcgcaggcgggaatccagtgcgttgagtttcagctatttagaataaattttgaaactctaatcgcgccattcccacgaaagtgggaatccagaatctcggactttcagataacctttgaatattgctgttgttctaaggtctagattcccgcctgcgcgggaatgacgaatccatccgcacggaaacctgcaccacgtcattcctacgaacctgcaccacgtcattcccacgaacctgcaccacgtcattcccacgaacctacatcccgtcattcccacgaaagtgggaatctagaatctcagactttcagataatctttgaatattgctgttgttctaaggtctagattcccgcctgcgcgggaatgacggcagagcggtttctgttttttccgataaattcctaaaactcaaaatttcatcattcccacaaaaacagaaaaacaaaatcagaaacctaaaattcgtcattcccgcgcaggcgggaatccagaatctcggactttcagataatctttgaatattactgttgttctaaggtctggattcccgcctgcgcgggaatgacggcagagcggtttctgttgctcccgataaatgccgcaatctcaaatcccgtcattcccacgaaagtgggaatccagttttttgagtttcagtcattcccgataaattgccttagcattgaatgtctagattcccgcctgcgcgggaatgacgacagaacggtttctgttttttccggtaaattcctaaaactcaaaatttcatcattcctacaaaaacagaaaaccaaaatcagaaacctaaaatcccgtcattcccacgaaagtgggaatccagaatctcggactttcagataatctttgaatattactgttgttctaaggtctggattcccgcctgcgcgggaatgacgaatccattcatacggaaacctgcatcccgtcattcccacgaaagtgggaatccagaatctctaaagcttcagctaacctttgaatattgctgttgttctaaggtctagattcccgcctgcgcgggaatgacggcatcggtttgacggtatttaattgaattgtggaaattgatggattcagtgagattggcgagatgaagcctaccctatagcccgccttttacgaacccgcccctcccgaaaaacgcaaaaaatgccgtccgaaaacctttcggacggcattttcgcgtgcaaatcagtagaagacttcacgccagctgattcgtttcataccgcacgtcgggccggtaatgtccaagctgtccaaatcgttcatcagcagggtgcgcacccctttttgggagaagcagcggttgtttttgccggaacgcttgccggcggggtctataccgctgccgcccgcatcgccgtctgccgttgttgaaaatccgtctgttttcttttcatccagataacgcacattaaccggtttgtcgtaaacatatccgttcgggcagacgatttcattgcctttttgcatacaacctatagggatggatttgccgttgatgcctttcttatggccggaatattgcgcgacagcctgattctcggccggcacaatcgggcgcgcgcttttcttggtcagcttgccgccgtcggcggtattgatacccaaaatggcggtttccgcgccgcatttgtccgtacccgtatatttatggatggttacaaaggcggtacgcaataccacggtcggtttgacggtaacgcgctgtccgcccttcaatttcactacccaccctttgctgcccgatccgtcggatcgcttgtaatcggtcaggaataaggttttatcctcctgcttaagctcttgctcgagcagcccgcctcccaaaccgctgagttttacatttacgttattcgccaccgtatcgtcgtcgaagataccgtaaatatattgttcgctcgtactgagtacatcatcctcactcaaatcactgcccgtgccgaagataaccacgcgtttgtctttcagttgggaaatagcgggcgcggaagtaatcggttttgtgccttcaaaaatggcgcgtacagaccattgattaggatcttgattgctcaaatcaaagcggtacatactgccgccgcgatcgccggcataggcgatatcgaccgtgccgtccaaatctttatccaccagcgtgggggacgaaagcccgcccttgccaccgggtacttcgatttttttaatcagcgtgccgctgctttccaaatcatacacatacagcgcggttttattgtcgccgctggtaatgtctttagtcgcataaccggaggcgaggaaagcggcgtatttgccgtcgtgggttttgccgatttgcggcgtgccgacggtgtagcctaatttcacgccgttattgccattcttgtcatgtttgacatcaaacagggaaacgtctgccaggttgccgttgccgctgtcgattttgcttaaatccaaggcatacgcgcctctgccgccaaagcccatcgcgccgaacataaacacatggtctttcccgttccgttcgactttgcgcaagacaaagccgccgtccacgccgtagcggtcgcccacatagcttttttcggcaaaggcgcgcagctctttggcaagggtggattcggtgttttgaatatccttgcgcggcatcgtacccgggatataactgagcttcagattgtagctgcgcttgtccccgccgctttgtttgaagatatgcaccatcccgtcgttggcggaagtagccaaatactcgccgaccgccacgatggggctgttgacgatgtcgcccaaattgcgctcgtgcttgccgttgtcgcggctgcggtatttttggctgtattttggcttgccgtctttttcttctttgttgaatgtgttaaattgaccgtcatcattggaagcacgaaccgtccaaggcagcaatacttttttccactcgctggcatcaggcatgaagctcccttcactaacaatgccgaaagtgtcgtttttgccgtcatttccattaaaattggcgacctcatcattgtttctacccagtttgatctgctgtacgccgccatccaatcggatgatggtttgccgccctgtgaaattcggctgtcgattttcaatatccgacttagccaagtctgcgagggaatggcggccgggtttgttggggtcggtttttcttttcagattttgaaggaagatgcggctgctcgaactatcggggtaggtggaaaccgaagcggaatacatctgcaccttaccattttgcacaggtccgaaccacagcgcgggggcagtcagtgcgggggaaggggctttggtactcttattggggttatttgcgttgatgcagcggcctgctttgacttccggcaatttgagtttgacgctgactgttcctttctcttcatacgtccaactaccgttaaaaaagttactattccgtcttttccatgcttccgtcggctcgatgcgtgttttcaagatacccaaattaactgttttaccttgcacgatatttttaatgtgttttttatccagcaggtgcagcttggcgttcagataaaaggcgacggcgtggtgtttgtcctgatggtttttattattctgactcttgtaatcgtctgtcgtataaacgaggtttttgtctttgtgttggctgcccgcaccattttgctgcgtcacgtcctcgctaaaagaagataccaaagaaccttgtctctttggtttgaaggagctctctccgcccaaattgaaagacacgcccaaccaaggatgatccttcaatttgtaaatgggcgaattgtcgcggcttttgtcttcgtatatatccagcccgccgccgtttgccttttttgccaaactggaattgccgaaggtaaattgggttctataggcaactgtaggacaacctccgctggagcatgtgctaccttcgtagctgtagcctaccagccccgttttggtcgtaccaatctgatcaagggcatttttgcgctcggtcagcttagcggtatcaaaaccggaaacctttccgtagggcggcaggtaggtcgccgcgccgaaaacgacagtatcttttttttcagcaacaacttcatcggtattattgaatgagaaactaatgctcttttttgccaaaccaaaaccactcgtatggataacttcgcgttcattgcttttgtgcgtcaatgactgatattgatccccccactttacctcgggcagattttgcgcgttcattacaatagcgtatttatgcgtttgcgtttgcgtttgcgcttgcgcctgcccccccccccgccggtatgggaaaacatcaatatggcggtataaagcgcggtatggcggaaaacctgccgtttccaagttttattcatcttttattccttgagtttgccttcacgggacggggcggcgcgccgcgaacgccggggttcggtaaaccgcccgattccgcgcccgccgaattgctgattgaaaagccctttcacttggctgccaaaggggaatgttaagaaaagcaatgcgcccctttgacggggtacaatatataaggttaccgcgccattctaaccctgcgcacttatcacagtaaagcggtttttagcaaaccgctgcagatgcccaacggtctggattcccgcctacgcgggaatgacggcggagcggtttctgttttttccgataaattcctaaaactcaaaatttcatcattcctacaaaaacagaaaaccaaaatcagaaacctaaaattcgtcattcccgcgcaggcgggaatccagtgcgttgagtttcagctatttagaataaattttgaaactctaatcccgtcattcccacgaaagtgggaatccagaatctctaaagcttcagctaacctttgaatattactgttgttctaaggtctagattcccgcctgcgcgggaatgacgggtcttttataacctttgaatattgctgttatcccaaggtctggattcccgcctgcgcgggaatgacgaatccatccgcacggaaacctgcaccgcgtcattcccacgaacctacatcccgtcattcccacgaaagtgggaatccagaatctctaaagcttcagctaacctttgaatattgctgttgttctaaggtctggattcccgcctgcgcgggaatgacaggtcttttataatctttgaatattgctgttgttctaaggtctagattcccgcctgcgcgggaatgacgaatccatcctcacggaaacctgcaccgcgtcattcccgcgaacctacattccgtcattcccacgaaagtgggaatccagaatctcggactttcagataatctttgaatattgctgttattctaaggtctagattcccgcctgcgcgggaatgacgaacccatccatacggaaacctgcaccgcgtcattcccacgaacctacatcccgtcattcccacgaaagtgggaatccaggacgcggaatctcaagaaaccgtttacccgataagtttccgtgccgacagacctagattcccgcctgcgcgggaatgacaggtcttttataatctttgaatattgctgttgttctaaggtctagattcccgcctgcgcgggaatgacggtttagaagttgcccgaaacctcaaaaaaaaaaaaccgaaaccgaacaagccggattcccgcctgcgcgggaatgacgaacccatccatacggaaacctgcaccgcgtcattcccacgaacctacattccgtcattcccacgaaagtgggaatctagaatctctaaagcttcagctaacctttgaatattgctgttgttctaaggtctagattcccgcctgcgcgggaatgacggcggagcggtttctgttgctcccgataaatgccgcaatctcaaatcccgtcattccctcaaaaacagaaaaccaaaatcagaaacctaaaattcgtcattcccgcgcaggcgggaatccagtgcgttgagtttcagctatttagaataaattttgaaactctaatcccgtcattcccacgaacctacattccgtcattcccacgaaagtgggaatccagaatctctaaagcttcagctaacctttgaatattgctgttatcccaaggtctagattcccgcctgcgcgggaatgacggcggagcggttgctgtttttccgataaatgccgcaatctcaaatcccgtcattcccacgaacctacattccgtcattcccacgaaagtgggaatccagaatctctaaagcttcagctaacctttgaatattgctgttatcccaaggtctagattcccgcctgcgcgggaatgacggcggagcggttgctgtttttccgataaatgccgcaatctcaaatcccgtcattcccacgaacctacatcccgtcattcccacgaaagtgggaatctagaatcccggactttcagataatctttgaatattgctgctgtccaatggtctggattcccgcctgcgcgggaatgacggtttagaagttgcccgaaacctcaaaaaaaaaaaaaaccgaaaccgaacaagccggattcccgcctgcgcgggaatgacggcagagcggtttctgttttttccgataaatgccgcaatctcaaatcccgtcattcccacgaacctacatcccgtcattcccacgaaagtgggaatctagaatctcggactttcagataatctttgaatattgccgctgtccaatggtctagattcccgcctgcgcgggaatgacggtttagaagttgcccgaaacctcaaaaaaaccgaaaccgaacaagccggattcccgcctgcgcgggaatgacggcagaacggtttctgttttttccgataaatgccgcaatctcaaatcccgtcattcccgcgaacctacatcccgtcattcccacgaaagtgggaatctagaatctctaaagcttcagctaacctttgaatattactgttgttctaaggtctagattcccgcctgcgcgggaataacgggtcttttataaactttgaatattgccgttatcccaaggtctagattcccgcctacgcgggaatgacggtttagaagttgcccgaaacctcaaaaaaaaaaccgaaaccgaacaagccggattcccgcctgcgcgggaatgacgggctaaataatatcaaaccataaatcctgccaagaaacattattttcttcaatcagttgcaatttccaagccctgttccatttcttcaactgtttttcccgagtaattgcactctccatcgtaggatgcagttcataccaaaccagcatagtaacgttgtaccgtgatgtaaatccctcaatcaaatgctccctatgttggtaaatacgttgcaccaaatcagatgtaacgccaatgtataacgtgccattacgttggcttgctaaaatataaaccgcaggctgcatataatacccttttgaattatttcaatttatattcccgcgaacaccatcccgtgattactttaacccttcgttattcccatagctttccatcattcccgcaactcttcgtcattcccgcgaaagtgggaatctagaacgcaaaatctaaagaaaccgttttacccgataagtttccgcaccgacaaacctagattcccgcctgcgcgggaatgacggcggagcggtttctgttttttccgataaatgccgcaatctcaaatcccgtcattcccacgaaagtgggaatccagaatctcggactttcagataatctttgaatattgccgctgtccaatggtctagattcccgcctgcgcgggaatgacggcatcggtctgccgttacaacacggtttctttagattttacgttctagattcccgcctgcgcgggaatgacgaatccatccatacggaaacctgcaccacgtcattcccacgaacctacatcccgtcattcccacgaaagtgggaatccagaatctcggactttcagataacctttgaatattgccgttatcccaaggtctggattcccgcctgcgcgggaatgacggcatcggtctgctgttttcggacggcatttcggctcaatccagcagtgcgtccacaaacgcgcgcgcgtcaaacgggcgcaggtcgtctatgccttcgcccacgccgatatagcggacgggaacggggcggtcggaggcaagcgcggcgaggatgccgccttttgccgtgccgtcgagtttggtaacgattaaaccggtcagccccaatgcgtcgtcaaaggctttgacttggttgacggcgttttgcccgatattggcatcaagcacgacgatgatttcgtgcggcgcgtcgggcatggctttttgcagcacgcgtttcacttttttgatttcttccatcaaatgaagctgcgtgggcaggcggccggcggtgtcggccagcacaatgtcgatgccgcgcgctttggcggcttggacggcatcgaagcacacggcggcggaatcgcccgtggtttgcgaaatcacggttacgttgttgcgctcgccccaagcttgaagctgctcacgcgcggcggcacggaaagtatcgcctgccgccagcaatacggatttgccctgcgcttggaaatatttggcgagtttaccgatagacgtggttttgcccgcgccgttgatgccggcaagcatgatgacaaacggctctttggtttcgggcaaaaccaaaggtttctccagaggcttaatcaggtcgtacaaggcttctttcaacgcgccgcgcaattcgttgccgtctttcagccctttgaggctgacgcggtcgcgcacgtctttcatcaggtattcggtggcttccatgcccatatcgctggtaatcagcacggtttccagctcttcgtataaatcttcgtcgatttgtccgccgccgaacacgcccgccagcgatttcgccattttgtcgcgcgatttggtcaggccttgtttcaaacgcgccgcccaaccgagcttgtgttcttcagttgtcgcaacggcttcttgaacttgcccgacagcctcgccgacggtttcggcaacggcttcttttgccgcttcgacttgttccgctgctttttccgccgcttcctctgcttcagacagcatctcggcaacggtttcctttacctgttcaaccgcaccgctgacggtttcaacggcagattcgacctgccctttgacgctttctgctaaagattcagcatcttctttaatattttcaactatttgagcaagttcagattctgcttttgctgcggtttcctgaatttgagcctcctcgagagccggcgtttcctgttttttcttgcgacggaagaagctgaacattgaattttccttttaattttagaaacttgaaacagggcgtattgtagcgtattttacgcggtaaggttgtctgaaaatccgggctgtaaggtttcggcatctcaaacgtctaatcatgcaaaccgtccacacaggaaacatcaaaatgaaacaccgtactttcttttccctttgcgccaagttcggctgcctgcttgcgctgggtgcttgttcgcccaaaatcgtcgatgccggagccgcgaccgtgccgcacactttatccactttgaaaactgcggacaaccgccccgccagtgtttacttgaaaaaagacaaaccgacgctgattaaattttgggcgagctggtgtcctttgtgtctgtccgaattgggacagaccgaaaaatgggcgcaagatgcaaaattcagctccgccaacctgattaccgtcgcctccccgggctttttgcacgagaaaaaagacggcgacttccaaaaatggtatgccggtttgaattatcccaagctgcccgtcgtaaccgacaacggcggcacgatcgcccaaagcctgaatatcagcgtttacccctcgtgggcgttaatcggtaaagacagcgacgtgcagcgcatcgtcaaaggcagcatcaacgaagcgcaggcgttggcgttaatccgcgacccgaatgccgatttgggcagcttgaaacattcgttctacaaacccgacactcagaaaaaggattcaaaaatcatgaacacgcgcaccatttacctcgccggcggctgcttctggggcttggaagcctatttccaacgcatcgacggcgtggttgacgcggtatccggctacgccaacggcaacacgaaaaatccgagctatgaagacgtgtcctaccgccatacgggccacgccgaaaccgtcaaagtgacctacgatgccgacaaactcagcctagacgacatcctgcaatatttcttccgcgtcgttgatccgaccagcctcaacaaacagggcaacgacaccggtacgcaataccgcagcggcgtgtactacaccgaccccgccgaaaaagccgtcatcgccgccgccctcaaacgcgagcagcaaaaataccaactgcccctcgttgttgaaaacgagccgctgaaaaacttctacgatgccgaggaataccatcaggactacttgattaaaaaccccaacggctactgccacatcgacatccgcaaagctgacgaaccgctgccgggcaaaaccaagaccgccccgcaaggcaaaggcttcgacgcggcaacgtataaaaaaccgagtgacgccgaactcaaacgcaccctgaccgaagagcaataccaagttacccaaaacagcgcgaccgaatatgccttcagccacgaatacgaccatttgttcaaacccggcatttatgtggacgttgtcagcggcgaacctttgttcagctccgccgacaaatatgattccggctgcggctggccgagcttcacgcgcccgattgatgcaaaatccgttaccgaacacgatgatttcagctacaacatgcgccgcaccgaagtgcgcagccacgccgccgactcgcatttgggacacgtcttccccgacggcccgcgcgacaaaggcggactgcgctactgcatcaacggcgcgagcttgaaattcatcccgctggaacaaatggacgcggcaggctatggcgcgttgaaaggtaaagtgaaataagccgcaccgccgcctaccccgacaaaatgccgtctgaaacccgaaacgtttcagacggcattttttatccgatggggattttgttcagacggagattttgtttagacagcatcgccgccgttttcaatcagccccgccaaccgttccaacgcgaaggcgaccgcctgcgcgcggacggattcgcggttgccgtcaaaacggcgcattgcttcgcaacttccgcccggaaaggcaaacccgaaccaaaccgtgccgacgggtttgctttcgctgccgccgcccggaccggcgatgccggaaataccgacggcgtaatccgcctgcgccacggctttcgcgccgcgcgccatctcatagacggtttggcggctgaccgcgccgtgttcgagcagggtttcgggcaacacgcccaagcggtcttctttggctttgttgctgtatgttacaaaactctggtcgaaccattgcgaactgcctgcaacgcttgtgaatgcggcggcaagcattccgcccgtacaggattcggcacagcttacggtttgacgttttttcgtcaggtttcgggcgatggtgtgcagcgcgtccatttcccactcctctttcagacggcgtttaagaattgatgatgtgtatgtcgcgttgcgggaacgggatgttgatattgactttgcggaggttttcgaccacttgttcgttcaagtcgcattgcagcgtccagcggtctgcttcgtttgcccaagcccataatgtgatttcgatggcattgtcgcccaaggcggtgatgtaggcggcagcctgccgctcttcgttttgaacgctcaaggggtgttcgacggcggctttcaacaccgcctctttcgccactttcaaatcgcagttgtaatcgacgccgactatcacttgggcgcggcacagcggcagtgtggaacggttgacgatgctgttgcccatcaccacgctgttgggcagcacgacttcttcgttgtcggtcgtccgcaaagaagtctgcaccattttaatctctcggacatatccttcaaaaccgccgacgcggataaaatcgccgactttgaacgggcggaacaggataatcagtgcgccggcggcaaaattggacagctggtctttcagggacaacgccaccgccaaacccgcgccgccgattaaggcggttacggatgttgtggaaacgcccaatctgcccaatgcggcaataatcaccaaaatcaataagccgatattggcaacattacacaaaaaactaatcagcgtggcatcgacctgcgcgcgcgtcatcgccgccctcatcacagcgacaatgcgtttcgccgcccattttccgaccaaaaaaataagcagcgcggcggcaaggttcagcccgaacgcccacgccttttcagccagatgctcccaaccggaaacactgatcaggtgtaaaaaatcaaattgtttgaagtccattgttttcctcttgatcgaacatccgccccgtgcggcgtaatcggcacaggtgtaaaaatgccgtatgaagccctgcggggaggtatgtttgttttatttcaaaaccgttctaatccaacgggaaacccatccgcgctggttcgcatcaatatcgcgctgcgcgggggcggtggtgtgcgtcggggcttgggcgaagcggaacacgtcgggcaggcgcgtgtttttgacggcggggtaaacccacatttcggacggaaccgcctgctgcacttcccgactttgcagccattgcaccagttttgccgccaattccggctgtttcgcgcccttcaagaccgccgcgccttcgacctggcggaatacgccgccttttaaaaacaggttgcccgtcggcggctcgctgtatttgcctttggaaaaatacacttccgccgccgggctggcggcataaccgaccaccagcggatacgcgccgccgttgtgcgaaaagtcggtgtaatacgcctcgctccagcctttggcgaccttcacgccgttctgccgcatctgtgcccaccatttgaacgcgctttcttcgcccagaccgctgatgttcgccatcaggaagcccagccccggggacgacgtggcgggggacggcacgaccaataggtttttatattcggggcgggtcaaatcctgcagggtttgcggcaggggcagctttttgccttcaaaccattttttgtcgtaattgatggacacatagccgtaatcgaccgccaaagccgaaggcagcccgaccgcgacgggggcggattcgggttgcgccgccgccaaaatgcccatttcccgcgccttgccgatattggcgttgtccaaaccatacaccgcgtcggcaatcgggttggcgcggctcaaaatcagtttgttgagcatttcgttcgcgccgcccgcctgaataatcgacaccttcgcatcgtttgcccgctcgaagcgcgcaatcaaccctttgggcaggctgaacgacttatgcaccgccagcctgacttccgtctgcgcctgcaggtatgccgaaaccgccagcagcggcagcagccaaattttccgtttcattccgagtcctcctctattcgctgtaaaataacattctaacaaattttcacggttcaacatgcaagaaaacccgaccgtgtggctgttcgacctcgacaacacgctgcacgatgccgacgcaggcatcttcacactcatcaaccgcgctatgacacgctatatggcacgccgcctcaaactctccgaatctgccgcgtccgacctgcgtcaagactattggcaccgctacggcgcaacgctcgccggactgcaaatccaccatcccgaaatcgacatcgccgaatttttgcgcgaaagccatccgatcgatgcaatcctgaccaggctgcacggcatgcctgaaacacaaaacaccctgagccgcctaaaagggcgcaaggcggttttttccaacggcccgtcgttttacgtccgtgccgttgtcaacgcactcggtttggaaaaccgtttcgacgcgcttttcggcacggatgatttcgggctgctgtacaaacccaatccgcaagcgtatctcaatgtctgccgcctgttggacgtaccgcccgaatgctgcattatggtggacgacagcgcggacaacctgcatcaggcaaaggcgctgggtatgaaaaccgtccggttcggtgcaaaatcccacgcgctgccctttatcgatgcctccgtaagcgatatggcgcaactggctcggtatgcagaaactttgtcagaacaccgccaaaatcattacaataccccctaccccccgaaaatacgaaagaaaagccatgcgtaaaaccttcctcttcctgaccgctgccgccgcccttttgtcgggctgcgcgtgggaaacttatcaagacggcaacggcaagaccgccgtccgtcaaaaatatcccgccggcacgcccgtttattaccaagacggcagctactcgaaaaatatgaactacaaccaataccgtcccgaacgccatgccgtgttacccaatcaaaccggcaacaacgccgacgaagagcatcgccaacactggcaaaaaccaaagtttcaaaaccgataaacctaccctatgccgtctgaagccgcttcagacggcattgcacaggaaaccgtcatgccgcaaaacactttaaacatcgtcatcctcgccgccggcaaaggcacgcgcatgtattccaaaatgccaaaagtgctgcaccgcatcggcggcaagcccatggtcgggcgcgttatcgacaccgcagccgcactgaatccgcaaaacatctgcgtcgtcatcggccacggcaaagagcaagtcttggacaccgtcaaacgcgatgtcgtttgggttgaacaaaccgaacagctcggtaccggccacgccgtcaaaaccgccctgccccacctttccgccgaaggccgcacgctggtgttgtacggcgacgttcctttaattgacgttgaaaccctcgaaaccctgctcgaagccgcaggcaacgaagtcgggctgttgaccgacgttcccaacgacccgacaggcttggggcgtatcatccgcgacagcaacggcagcgtaaccgccatcgtcgaagaaaaagacgccgacgccgtccaaaaagccgtgaaagaaatcaataccggcatcctcgtcctgcccaacgccaaactcgaaaactggctgaacagcctttccagcaacaatgcacaaggcgaatactacctgaccgacctcatcgccaaagccgttgccgacggtattaaagttcatcccgtccaagtgcgcgcctcccacctcgccgccggcgtgaacaacaaactccagctcaccgaactcgaacgcatcttccaaaccgaacaggcgcaagaattgctcaaagcaggcgtaaccctgcgcgatccggcacgtttcgatttacgaggccgtctgaaacacgggcaagacgtcgtgattgatgtgaactgtatctttgaaggcgacatcgagctcggcgacaacgtcgaaatcggcgcaaactgcgtcatcaaaaacgccaaaatcggcgcaaacagcaaaatcgcccccttctcccacctcgaaagctgcgaagtcggcgaaaacaaccgaatcggcccgtacgcccgcctgcgtccgcaagcccgccttgcagacgacgtacacgtcggcaacttcgtcgaaatcaaaaacgccgccatcggcaaaggcaccaaagccaaccacctcacctacatcggcgacgccgaagtcggctgcaaaaccaacttcggcgccggtacgattattgccaactacgacggcgtgcacaaacacaaaaccgtcatcggcgacgaagtgcgcatcggttcaaactgcgtcctagtcgcccccgttaccctcggcaacaaagtaaccacaggcgcgggcagcacgattacccgcaatgtcgaagacaacaaactcgccctcgcccgcgcccgccaaaccgtcatcgaaggctgggtgcgtcctgaaaaagacaaacaataaagctatgccgtctgaagccggtttcaggtttcagacggcaccccaaaacaaacatccgataaggacggcaaaccatgtcattacccccatgcccgcaatgcgcctccgaatacacctatgaagacggcggacaatacatctgccccgaatgcgcccatgaatggaatgaaaccgaatccgccgccgaccttgcggctcaagtgcgcgatgccaacggcgcagtgctgcaaaacggcgataccgtcatcctcatcaaagacctcaaggtaaaaggcagctcgatggtgatcaaacaaggcacaaaagtcaaaggcatacgcctgcaagaaggcgatcacaacatcggctgcaaaatcgacggcagcgcgatgaatttaaaatccgaattcgtcaaaaaagcctgaccgcccaaaaacaagaaacgccgtccgaacccgtttggcaaggttcggacggcgttttttatatggcggatttatacgcccagcagcccttgccccaaaaagccgcctttttccacgccgggcaagacgaagaaatagccgccgccgaaggggctgatgtattcttccagcggttcgccgttgaggaggttttgcacgaagatgaatccgtcggcaaggtttgcctgatagcagacgaacaccagcccgacatcaagctgtccgcttgaggcgagtccgcgcgaatagctgtaggcgcggcggaagaggcggtgttttttgaggaattcgggatcgcgcggattcgccaggcgtatatggctgtctttgggcgtgatatcaccctcggggtctttggcaaaatccggttggtcggcttcttttttgccgtccatcggcgcaccgctgtatttgcgccgcccgaaaatgtcggtttgctcttgaagcggcgtcctgtcccaaaactcgacaaagtggcggataaggcggactgcctgatagctgccgtttttcgcccactccggttcgtcgaggctgttggcggccacccccgtccacaaaacctcgtcggcagttttgggatcggaaactttggggttgcccgtgccgtccctgaagcccaacaggttgcgcgccgccatcgcgccgggttcggatttgggctgccacccgtcgatactccaacggataacggcggtttggacggtgtgtttgatgatgtcgcgcagggcggcttggcaggtttcgggggtgaaggcacagatttgcaggctcaaatcgccgtcgcaccagcttttttgcagcttatcgttggagaagtcgcgcatttcctgcaaatgaatcggttttttgtctttgagtccgaaccggccgtcaaacaggctgctgcccacccccacggtaacggtcaacccgtcggggttgaaggctttgcccaaaatgccgctgccggctggcggaagtttgtcgtcgccgtcttggtattcgccgccttgggtgagaaactcgatgcgggcggtcagcgtgcggaacaggttttccagctgcttggcactttgcgcggttacgtcgaaggcgcacataatcgaaaacgcctgctgcggcgtaacgatgcctgcctgatgttcgccgtagcagggataggcttggggcgagtgttggctttcggcggtgcgttcggcggtttcgccctgttttttgccgccgagataacctccgattgcgccgactgctccggctgcgatcgcggttttaaaaagagtgcgcctggtcggttgtgcgggttgttttttgctcatggtgtttccttcaatatccgtgcagcaggatgggtatccctgcacgccgtttttccattaaccgatagcggcaggttgaaatcccgccctgcaatatatggcggatatagtggattaacaaaaatcaggacaaggcgacgaagccgcagacagtataaatagtacggcaaggcaaggcgaggcaatgccgtactggtttttgttaatccactataaaacttcagacggtatctgccgccaaataccgtctgaacgcttgcggcttatttcaagccgagtatgccgcgaagttgggcaaggtcttcggcaagcgcgttaatagaggcctgtaacgctttgcggtcggcttcgcccagcttgtcgtaggtttcaaaaccgtctttagtccggtatttcgccagaatttcgttgacctgtttgaagttggtatcggttttttccaacaaggctttgtttttggcctcgatcagcggacggaacaaatcgacgatttttttagatccgtccacattggcttggaagtcgctcaaatcggtgtggctgtaccggtcttcttcgccgctgattttactgcccgccacttcttcaatcagttcggacgcgccgccgaccaccttgcccggaggaaacgccaatgcgtcgatttctttttgcagggcttcgacatcggtcatcagtttcgctgcaatttccttcacgccggacacgtctttttccacccaaagggcgtattcgatacggtgaaagccggtaaatccggcatctttcgcgccgtctttgaagtcgtcttcacgcgcatcgatgacggggtcgagttcgctgaaaagctcggcaatcggttcgatgcgttcgtaatggacgcgggtgtcggcaaacagggatttcgccttttcaatgtcgcctgctttgacggcttcggtaaaagttttggttttcgccaccagctctttaacctcgccttgaacgtaggctttatagtcggcgagcggttgggacagtttttccaaatccgcttcgttggcggtgtctttaaagccgctgtcggttaccaccagcttgccgcgcggattggtcaaaagaccgcaagtcatttcgtattcgcccggcaacagggtgacggtcattttatcggaaagtccgggggcgatgttttcgcgctcgtccaccaccatcacgcctttcaggatttcccattcgagcttgcggccgctgttgtttttaatattgaacacaacctgtccgctcggcacggtcagttccatcggttcgcaggcattgtcgttgacggcgatactgaccgaaccgccctcgttggcggtttgcgcctcaccggacgctgccggcgcagctttctccgcctccggcggctggcacgcggtcaaacctaaggcaagcatcacggacaatgcggtcaaattgaattttctcatttcagctcctctttacgggttaaagtttcagacggcctgctgccgcacaaaaaccaagttatgacgggaataaggtacagcagccaaaccaaggtctcgccctgcgtcggatggtcggtatagccgaaaaatccgccgagcagcacgcccaacggactgtcttcgtgcaaatattttgatgagtcgaacacaatgtcctgaagcgcgttccaaatacctgcctcatgcagcgcgcgcagcgagccggcaagcaggccggcggcaacgacaatcagaaacgcccccgtccaacggaaaaacttcgccagattcaggcgcatcccgccctgataaatcaacgcgccaatcacggcggcagccaaaacccccgctaccgcgccggccggcatctgccacgtcgggctctgtttgaatacggcaagcaggaaaaaaacactctccagaccttcgcgcgccacggcaagaaacgccataccgaccaaggcccatccttgaccgctgccacggttcaaagccgcctgcacagaatcctgaagctgccgcttcatcgaacgcgccgcctttttcatccataaaatcatataagtcagcatggcaacggcaaccaaaccgataatgccgacgacgaactcctgctgcttctggggaatctcgcccgttgccgaatggatgccgtaccccagccccaaacacatcaaagaagcaaggacgaccccgaaccagaccttaggcatcagtttggaatgtccggactgtttcagaaaaccggcaacgatgccgacaatgagcgcggcttcaataccctcgcgcaacataattaaaaaagcgaccagcataaacgcgaacgaacaaggatgatgaataatatattatcggaatattttcattgcttgtaaatacaaatgcaagttatttttatctgcagtaccgcgcggcggaaagttccgcaggctgcagctgcgccctgtgttaaaatcccctctccacggctgccgcaacgccgcccgaaaccatctttcttattactgccggcaacattgtccattatgaaaaaatacctattccgcgccgccctgtacggcatcgccgccgccatcctcgccgcctgccaaagcaagagcatccaaacctttccgcaacccgacacatccgtcatcaacggcccggaccggccggtcggcatccccgaccccgccggaacgacggtcggcggcaggcggggccgtctataccgttgtacgagcatcgggctgaaaacgcttgggcgttcaggctgaaccttgccgccgcgctgcttatttttttggtcggaaaatgggcggcgaaacgcattgtcgctgtgatgagggcggcgatgacgcgcgcgcaggtcgatgccacgctgattagttttttgtgtaatgttgccaatatcggcttattgattttggtgattattgccgcattgggcagattgggcgtttccacaacatccgtaaccgccttaatcggcggcgcgggtttggcggtggcgttgtccctgaaagaccagctgtccaattttgccgccggcgcactgattatcctgttccgcgcgttcatagtcggcgattttatccgcgtcggcggttttgaacgatatgtccgagagattaaaatggtgcagacttctttgcggacgaccgagaacgaagaagtcgtgctgcccaacagcgtggtgtatggcgacgggcgatgacggggataccggataggtcagtgcggtttttacctttttgcggatggcctgggttttttctttgtaaattgccaatttgtccagcaggctttccaatacgccgcccgtttcgcccgccgcaac

SEQ ID NO: 37800 - DNA, 50925 bp, Neisseria meningitidis
ccggatttggtgcgaaaaatttgcattccgccgaaaatttcggtttcagacggcattcaaatgttttggctgcccagccagcgttccgcgtccaaagccgcctgacagccggaagccgcgctggtaatcgcctgacggtaggtatggtcttttacgtcgcccgccgcccatacgccttcgatattggttgcgccgacattgtccgccgtgccgcctttggttttcaggtaaccggcttcgtccatttccaactgacctttgaaaatatcggtattcggcttgtgcccgatggcgataaaaatgccgctgacggcaatttgttgctcagaaccgtcgttgttttttaataatgcgccgtttacgccccgatcgtcgcccagtacttcttgcaggttgctttccagcttgaggatgattttgccctcttccacgcgtttcatcagtttgtcgatcatgattttttcggcacggaactcgctgcggcggtggatcagggtaacggttttggcgatattggcaaggtagagtgcctcttcaactgccgtattgccgccgccaactacggcaacatcttggtttttatagaagaaaccgtcgcaggtggcacaagcggaaacgccttttcctgcaaacgcttcctcactcggcaaaccgaggtatttggcggacgcgcctgttgcgacaatcagggcatcgcaagtgtactcgcccatatcgcctttgagtgtaaacgggcgtttttgcagatcgacggcgttgatttggtcaaaaatgatttccgttccgaaacgttcggcgtgggcgagaaaccgcgccatcaattccggcccttgcacgccgtcggcatcggcaggccagttgtccacttcggtggtggtcatcagttgcccgccttgcgcgatacctgtaataatgacggggtttaaattggcgcgcgcggcatagacggcggcggtgtatccggcggggccggaacccaaaataatcagtttgcggtgttgggacattgtttttcctttgctgtgtcaagttttcggattctactcgaattatcggcgcgtttgagaaatttcgaccataccggcgctcagacggcatcccgcagccttaactgccgtctgaatatcaaagcaggaatcacgcttatgcaacaaaaaatccgtttccaaatcgaaggcatgacctgccaggcctgcgcttcgcgcattgaaaaagtgttgaacaaaaaagattttgtcgaatcggcgggggtaaacttcgccagcgaagaggcgcaggtagtgtttgacgacagcaaaacctcagtagccgacattgccaaaatcattgagaaaaccggttacggcgcgaaggaaaaaacggaagatacattgccgcaacccgaagcagaacaccatatcggctggcggctgtggctgctgttcaccatcaacgtcccgttccttatcggcatggcggggatgatgatcggcagacacgattggatgattccgccgttgtggcagttcgcattggcaagcgtggtgcagctttggctggcaatcccgttttacaaaagcgcgtgggcgagcattaagggcggactggcgaatatggacgtgctggttaccatcggcacggtctcgatttacctgtattccgtctatatgctgtttttcagcccgcacgcggcgtacggtatggcgcatgtgtattttgaagtgggcgtgatggtgatcggttttgtgtcactgggtaaatttttggaacaccgtaccaaaaaatccagcctcaacagcttgggcttgctgctcaaacttacaccaacccaagtcaacgtgcaacgcaacggcgaatggaaacagcttcccatcgaccaagtgcaaatcggcgaccttatccgcgccaaccacggcgaacgcattgccgcagacggcatcattgaaagcggcagcggttgggcggacgagagccatcttaccggcgaatccaatcctgaagaaaaaaaggcgggcggcaaagtgttggcgggcgcgttaatgaccgaaggcagtgtggtgtaccgcgccacgcagctcggcagccaaacccagctcggcgacatgatgaacgcgctctctgaagcacaaggcagtaaagcaccgattgcgcgcgtagccgataaagcggctgcggtattcgtgcctgccgtcgtgggcattgcgttgttgacttttattgttacttggctgattaagggcgattggacggttgcgctgatgcacgccgtcgccgttttggtgattgcctgcccgtgcgcgctgggtctggcaacccctgccgcgattatggtcggtatgggcaaagcggttaaacacggtatttggtttaaagacgcggcagcaatggaggaagccgcccacgtcgatgccgtcgtgttggacaaaaccggtacgctgaccgaaggcagcccgcaggttgccgccgtttattgcgttcccgacagcggctttgacgaagacgctttgtaccgcatcgccgccgccgtcgaacaaaacgccgcccatccgctcgcccgtgccatcgtctccgccgcccaagcgcgcggtttggacattcccgccgcacaaaacgcacaaaccgttgtcggcgcaggcattaccgccgaagtggaaggcgtgggtttggtgaaagcaggcaaagccgaatttgccgaactggccttgccgaagtttttagacggcgtttgggatattgcaagcattgttgcggtctcagtcgataacaaacccatcggcgcattcgcacttgccgacgcgttgaaagccgataccgccgaagccataggccgtctgaaaaaacacaatatcgatgtctatattatgagcggcgacaaccaaggcacggtcgaatacgtcgccaaacaactgggcatcgcacacgccttcggcaacatgagtccgcgcgataaagctgccgaagtgcaaaaactcaaagccgccggcaaaaccgtggcgatggtcggcgacggcatcaacgacgcgcccgcgcttgccgccgctaacgtcagcttcgccatgaaaggcggagcggacgttgccgaacataccgcatccgccacgctgatgcagcattcggtcaaccaactcgccgatgctctgctggtgtcgcaagccactttgaaaaacatcaagcaaaacctgtttttcgccttcttctacaatattttgggcattcctctcgccgcgcttggctttttaaatcccgtcatcgctggcgcggcaatggcggcaagctcggtttccgtgttgagcaatgccttgcgcctgaaacgggtaaaaatcgattagcagcatgtaaccgccctgcagccttgtccgaacggataaggctgtctccagcgatatggtaatatgccgtctgaaaccgtttttcaagtaattgatatgaataaagaaacccgttttccggaacacttcgacatcccacttttcctcaaaaacctgcccaacctgccaggcgtataccgttttttcaacgaaagcggcaacgtcttatacgtcggcaaagccgtcaacctcaagcggcgcgtgtccggctatttccagaaaaacgaccattccccgcgcatcgcattgatggtgaaacaggttcaccacatcgaaaccaccatcacccgctccgaatccgaagccctgattctcgaaaacaacttcatcaaagccctgtcgcccaaatacaatattcttttccgcgatgacaaaagctatccttatttgatgctcagcggccatcaatatccgcaaatggcgtattaccgcggcacgctgaaaaagcctaatcaatatttcggcccatatcccaacagcaacgccgtgcgcgacagcattcaagtgttgcaaaaagtctttatgctgcgtacctgcgaagacagtgtattcgagcatcgcgaccgtccttgtctgctttaccaaatcaaacgctgcaccgcgccttgtgtaggccacatcagtgaagaagattatcgtgacagcgtgcgtgaagccgcgactttccttaatggcaaaactgacgaattgacgcgtaccctgcaacacaaaatgcaaaccgccgccgctaatctacaattcgaagaagccgcacgttaccgcgatcaaatccaagcgctcggcatcatgcaaagtaatcagtttatcgacagtaaaaatccgaacaatcccaacgatatcgatttgcttgcactggcggtttcagacggcctggtttgcgtacactgggtcagcatccgcggcggacggcacgtcggcgacaaaagctttttccccgacaccaaaaacgatcccgagccaaacggacaagattacgccgaagccttcgtcgcccaacactatctgggcaaaagcaaacccgacatcatcatcagcaactttcccgttcccgatgcgctaaaagaggctttggaaggcgaacacggcaagcagatgcaatttgtcaccaagaccataggcgaacgcaaagtccggttgaaaatggcggaacaaaacgcgcaaatggcgattgcacaacgccgcctgcaacaaagcagccagcaacaccgcattgatgaactggcaaaaatcctcggcatggattcagacggcctcaaccgccttgaatgtttcgacatcagccacacacaaggcgaagccactattgcgtcctgcgttgtgtacgatgagcaaaacatccagccttcgcaataccgccgctacaacatcacgaccgccaaacccggcgacgactacgccgccatgcgcgaagtgttgacgcgccgttacggcaaaatgcaggaggccgaagccaacggcgagaccgtcaaatggccggatgccgtgttgattgacggcggcaaagggcaaatcggcgtagccgtatcggtatgggaagaactcgggctgcacatccctttggtcggcattgccaaaggcccggagcgcaaagccggtatggaggagctcatactgccttttaccggcgaagtcttccgcctgccgcccaacagcccggccttgcatctattgcaaaccgtacgcgatgaatcgcaccgtttcgccattaccggtcaccgcaaaaaacgcgacaaagcccgcgttacctcctccttaagcgacatccccggcgtaggcagcaaacgccgccaagccctgctcacccgcttcggcggtctgcgcggcgtgattgccgccagccgcgaggacttggaaaaagtggaaggcatcagcaaggcattggcggaaacgatttacaatcatctgcattagcatgctgtcaaagacaaaatccgtctgtaaaaaatatgatacagcaggtcggtataccgatatatagtggattaaatttaaaccagtacggcgttgcctcgccttgccgtactatttgtactgtctgcggcttcgtcgccttgtcctgatttttgttaatccactataaacctaacttcataacgaataacgatgattcgacaaaacggaaaacgatctgacatgaacaatcccgacttaccctatcggcaggccttagaatgcctgtctcaaaaacaatataactttaccgaagtccgccgactgctgacagaagcgttctcggcaggtcatcccgccgccgcattcgagttggcaaaacacctgatggacgcggacagcccctaccaagaccgcgaacaaggtatggaaatgctccgcatcgccgctgaacagggacatccctacgcgcgttacaatctggcatatatccaagaattggaaggcgcacccccggaaaccctgataccgctttacagaccgttggcagaagaaggactgcccgaagcgcaagtccgcctgatgtaccttctgtacgcgtcccgacattttgaagaagccttggaatgggcaaaaacaagcgcaaaaaacaacaacccccacgggcaatacctgcttgcccaatactgccggtacggcacaccgccggattttgaaacggcgcacctgctctaccgaaaatcggcggcacaaggcttgccggaggcacattggcagctcgggctgcaatatcgtttcgggcaagggacgaaagtcgacacggcacaggccgtcaatcatttgcgcgccgccgcacaacaaggatacattcctgcctacaccccacttgccgagctcatcctacctacggctcctgatgaagccgttcactggtttcaacaggccgcacaggaaaatgaccccgatgcccatgccgcacttgccgacatctacctgcaaggcaagcatctggaaagaaaccacaaacttgccctgcatcatgccgaagcagccgccgccgaacgccatcccgaaggtttgcggatactgggcgacatctgccgctacggtttgggcatagcccccgatacggaaaaagcccggcattattatcggcaggcagccgaagccggcagcctttccgcctatcagaaactcatatccgacagcgcgttaaaccatcctgaccaatacggcggcattaaagattccgccatcaggcggcaaagggcagaacggctttatcaaaaagcccaagccctgcattacggattacaatgcgcgcccgaatacgcagccgcgctcaaactctacacagaagccgcagaactcggacacagcaaagcccaaaccaatctgggcagcatgtattacttcggacagggtatgaccgccgactacaatgaagcacgcaaatggtttgaaaaagccgccgcgaaaaaagacagtatggcgttctacaacctcgcctgcatccattacagcggacacggcgtcgagccggacaaagaaaaagcctgccgctacctgcaagaagccataaacaacggatacgggcaaaaaagcgtcctgcaagaactgctgcaacaatggcaaaatgccgtctgaacagcgttacacctaccctgccgaaacgaaacaggtataatcgcccctttcccttcccgccgtccgaacaggcatttcacattcagacggcatcctgattgcacaagcgtacgaaagcattatgacagacaccgccgagaaccaaacacaaaacaactggcaagccggacacccccgcagcatccgcagcttcgtcctccgccaaagccatatgaccgccgcgcagcaacgcgccatcgataccttatgggacagcttcggcatcgactaccaagcaacaccggccgatcttgatgcccgtttcggaagcagccgacccaaaatcctcgaaataggcttcggtatggggacggcaaccgcagaaatcgcccgccgcctgcccgaaaccgacttcctcgccatcgacgtacacggtcccggcgtaggcaacctgctcaaactcatagacgaaaaccatttagaaaacatccgcgtgatgcggcacgatgccgtagaagttgtcgaaaatatgctgcaagacggctcgctcgacggcatccacatattcttccccgacccgtggcacaaaaaacgccaccacaaacgccgtctgatacaagcccccttcatcgccaaactactgcccaaactcaaaaccggcggctatatccacctggcgacagactgggaagaatatgcacagcagatgcttgaagtcctcagtagcttcgacagcctgcaaaatacggcggcagactacgcccccaccccggactaccgccccgaaaccaaattcgaagcgcgcggcaaacgcctcggacacggcgtttgggacttggtattcaaacggatcggataacaaaccactgtttgaaaatgccgtctgaaacatgtttgcttacagacggcattttttcaagataaagcagcaagtgatgtttcgatataaagtttaaaacaatagtttgaacggcaaaacgcgtgtgtaccgcacgcatccttataggttttatgcacatcggttttaaagtttgtgccgcccgcaggtagtatgtgatagctacgcacgcggttggtgtgatgtaggctacggcttgctggttacaaccgtaaaaaagtaagtgccgccattgcggtaaaaacgaagggatttcatagtgttatgctcgtaatgattttgtagattggattctcgaatccgaccttttgggcattgctgcaatggattgcaacgacgggaatgttgaaggttttgtcggatacaagtatccgacctacgcttgttgctatatatcttttgatttaatgactaaatatgacaaagttaaagtgcagattacagcaagcatgatatgcttctttaggcttttatcattccatgatatagatatttcttccttttcattttctttataaaattttaaacctatatcaccatttttccattcctggtggtttactatgattttatttttaaaagaatctcttaaactttcatgtaaagagttaaattttcttgatttacttcccttagtacatggtgagcaattgtatttctaattttatttaatctctcccctatatcatatacttcgctaaataagccaagattacgcgcaatttttagttttgtgcgaaatccaatttgtgtatcattgaaaaaatcttctttattacattttgcatatatccatgcctctaaaattctttcaaaaaataaatgtgttcgtaagattgaacctatttcatcctgtgtttcaatagcttctttcacgatatcaaaaatcttataatcatcaaaatttgaatttttaataaataattctaaattaaaatctaattgagacataataagtgcccatttcaaaaataaatctatattctagttaatataatagttattctaatatctaaattaaataataaactactatttttatatccacgacaaagtctaagtctcactccgccccaaacaacaaattctctttaatatccctaatcctatcccgcaacacagccgcctcttcaaactgcaaatccctagccgcctgctgcatggctttttcgagtttggcgatttctttaatcgcatcttcttcgttgtgaatctcgcccactttaaccttgtttttacctttcagacggcctttactgccgtcttcttcgtggtacacgccgtcgatgatgtctttgacctgttttttaatctgctgcggcacgatgccctgttcttcgttgaatttaatctgtttttcacggcggcgttcggtttcgtcgatagcggctttcatggagtcggtaattttgtcggcgtacaggatggcgacgccgttcacgttgcgcgcggcgcggcctatggtttgaatcaggctgcggtgggagcgcaggaagccttctttatctgcgtcgaggatggcgacgagagagacttcggggatgtcgaggccttcgcgtaagaggttgatgccgacgagtacgtcaaacaggccgagccgtaaatctctaatgatttcaacgcgctcgacggtgtcgatgtcgctgtgcaggtagcgcactttgataccgagttcgctgtaatagtcggtgagttgctccgccatgcgtttggtgagggtagtaacgagtacgcgttcgcctttttcaatgcggtcgttgatttcgctcattaagtcgtcgacttgggtggcaacggggcggatgatgatttggggatcaaccagccctgtggggcggacgacttgttcgaccacttgtccggcgtgttcttcttcgtatttggcgggggtagcggaaacgaagatggtttgcggcatgactttttcaaattcgtggaatttgagcgggcggttgtcgcgggctgaaggcaggcggaagccgtagtcgacgaggttttgcttgcgcgatgcgtcgcctttgtacatgccgccgatttgggttacggtaacgtggctttcgtcgatgaacatgatggcgttgtcgggcaggtagtccatcagcgtaggcggcggttcgccttcttttttgccggaaaagtggcgggagtagttttcgattcctttgcagaagcccatttcgtagagcatttcgaggtcgaaacgggtgcgctgttcgatgcgttgttgttcgacggggcgttgttcgcgggcgaaaaattcgatgcgttcgcgtaattcttctttgatggactcgcaggcgcgcaagacggtgtcgcgcggggtaacgtagtggctggacgggaagacggtgtagcggccgacgcgctggataaggctgcctgaaagcgggtcgaacatatcgaggcggtcgatttcgtcatcaaacaggctgatgcgtaaggcgttttcggagctttcggcggggtacacgtcaatcacgtcgccgcgcacgcggaagctgccgcgtttgaagtccaaatcgccgcgttcgtattgcatggaaacgagcgtggcgatgatgtcgcgctgctcgatggtatcgccttctttgacggacaacaccatttgttgatactcggtcgggtcgccgataccgtaaatggcggacacggtggcgacgataatcacgtcgttgcgcgtcattaggtttttggtggcggaaaggcgcatctgctcgatgtgttcgttgatcgcgctgtctttttcgatgaacaaatcgcggctgggcacataggcttcgggctggtaatagtcgtagtaggagacgaaatattccactgcgttttcggggaaaaattcgcgcatttcggcgtaaagctgggcggcaagggttttgttgtgcgccatgatgatggcggggcggccgctttgggcgatgacgttcgccatggtgtaggttttgcccgaaccggttacgccgagcagggtttgataggcaaggccgtctgaaagcccttcgagcaggcctgcaatggcggtgggctggtcgcctgcgggcgggaagggttggtggagtttgaagggggaatttgggtattggataacttccataatcttgcctgtgatgcgtttgcggacaaagcgtgcagtagggatgggtcggaaacgtctttcagacggcataaggcggtgaaatcctgaatgtatgccgtctgaaacccaatcgctacccaagtatagtggattaacaaaaaccagtacggcgttgcctcgccttgccgtactatttgtactgtctgcggcttcgtcgccttgtcctgatttttgttaatccactataaatgccgcacggttcaaattccggtaaaaaatcgctcataacctgtcctttcaaacataatatgccgtctgaaatcctttcagacggcatcgtcaaaacctacttcttatcttttttatctttcttatctttatttgaaaccggctttttcgccgccagccccaaagacttctgccactgctcgggcgacttgactaaatccaaagctttccgcaactggtcgtctttggcagggttgggaatccgccttgaagacaaatcctcgtcctttttctttttacctttttcttttacagcgggcttatccgcatctttttcaagcggcacggcaagggtttcaccgttcacatcctcgccgcccaagggattgccgatgtgtccgaccaaatccgcctcgcggctttcaaaaatgcgttccttatcttttacttcgacatcgggaacaatcccctgcgcctgaatagaacggtcgttcggcgtataatacagtgccgttgtcagcttgaccgcgctgccgttggacaaaggaatcaaagtctgaaccgaacctttgccgaagctctgcgtaccgacgatgaccgcgcgtttatgatcctgcaatgcacctgcgacaatctccgacgcggaagccgaaccggaattgaccaataccgtcatcggtatggttttcaactcggcaggaatgcccgccaacgaatcgccgcccatcccgtacacataatcttcaggaatggctttcagtaccatgcggtctttgccgtcgcgtcccttggtgctgacgacgactgcttcagacggcagaaatgccgccgacacgccgaccgcgccagtcaaaagcccgccggggtcgtcgcgcaaatccaacaccagccccttgagcggttttcctttattttcctttaccagctcttttgcggcggtattgacgctttcgaccgtccgctcttggaactgcgacacgcggatatagccgtaatcgggttcgatcaggtgatggcggacgcttttcactttaataatggcacgggtcaggttgacgactatcggcttgtcggcatttttgcgcgacagcgtcaaagtaatcttcgtacccggcttgccccgcattttcttcaccgcttcgctgaccgtcatgccgcgtgtcgaaacattatcgattttcacaatgaaatcgccgcttttcacccccgcccgttccgcaggcgtgtcctcaatcggcgaaaccactttgacaaatccgtcttcctgcccgatttccatccccaagccgccaaattcgccgctggtggactcctttatctcggcataaccttttttatccatatattcggaatgcggatccaaaccggccaccatacccttcatcgcaccttcaaacaaatcggcatcgggtttgtcctgatagtagtttgccttgatttgaccgtaaacctccgccattgtgcggatggattgcaccggcaggacttcgttatcccgcctgtccttctcggcggcaaaaccctgcaccgccagactgacggccacgccgctgattgcacccaaagtataaagtgcgattttcttaaaaacaggtttcgacattcttctttaactttctctcttgatttccaaaaaccggaaaatacaggtacggcaaacggcaaacttcacggaacagcgcaccatatcggcacgatttgcataaagcctaccgtttcggcaatccgatcaacgtatccagctcgaagggttcaatacctgaccttgataacgtatttgcaggtaaagcccctcttccccgtccggcagcgacccgctcgagccgattttgcttcctgccgcgaccatataacccttgccgacggaaatttcgctcaaaccggcatagatgctgatgtagttctcgccgtgatcgaccacgaccactttgccgtagccgtccaactcgtccgcatagcttaccgttcccggcgcaatgctttcaaccgttgccggtgcagtggaatagaacacgcctttccaaatatcgccgccgctccggttctgcccgaaaagtccggtcggcacaccgtcaaccggttttttcaaacgtccttgcatgcggctgaaaccgtcggcactgccgatacccataaccgaaggcgcttggatgttcctgtcttcggcggtcagttggacatttccgcacgtcgtgcttcagccttctgctgcgccgcttcttttctggctttttcggctgccgccagtctggcttcagccaattttctttttgcttccgcatcctgaatgcggtgttcggcctttttcttctccaaattgctcaagagcttgttcagctgctgctcgttccctttctgttccagcagttttcgggcatctttggcgattttggcattctgtctgcggctttccgtctgttccgccgcatcggttacaccctgttttttcagcagagattgcacgtttgcctgaattttcttcaaacgggcaagctcattgttgattttctgctcttgtaccgccaaagccttctgctgtttttccaaatccttgacaacttcccgattggaggcgtttacataacgcgtataacgcaaaaagcggtttttctgacccggttcggcgtttttcaggaacagggcaaccgcattcggctggctgtttttatagttccccgatacgaaacgggaaatctgcgctttcgtagcggcgacttccgttttcaaacggttcagctcggtattgagtttttggaacttgtcccaagcctcgcgctgtttgcggttgacggaagcaaggttgccgcgcgcctgacggatacgctcttggcggatacgctcttcctgaagctgtttgagggaattgctgacatgaagcagcattccttcgctttgtttgagcagggcttttttgttttcgacatcattggtggcagcggcaacggcggctttcaattcgtcggaatcggttttggcatttttctcttccctgtattttttgtcctgtttcactgctttgccgttcttgtcggaacggacttttttatttgcagaaacagtgtctttttccgccttgccgcccttgcgcggattgccctgtccttttgcctcttttttgccttgtttgttttcaggctgtgtttttgcgtttttttctttggatccggacacgggcttgccatgtgcctttttgtgttccgccttcgatttcttatccccttcgcgtcctttgcgcgcagactgcctggatgtcgcctccttctctgcttctttgcggtttttggcggtttttttggactctttgccctcttttgccgcctctttgccgcctgtttttttatctttcactgcgccatttttgcctttttcttttttgccttccgccgcttcgggctgttcttttttgttcttcgtctgttttttcacttcggcggaacggttgtgtgccgcgtcgtgggcggcaacggcgggcgtggaaaaaacgagcatcagggcaagcagaaggggtttgtagcgcatggttcgaccttcggaaaaagttggataatactgaaggctgcacgaaagcagccggacgtttggattatactgtcagttatgccgtctgaaaatgccgtttgcccaatcttgcgccttctttgcgcggatacttgcaatcggctcaaacagccttatattgtgcgtcatattttcaatgccgcaacggatattgtgttccgacacacagggtagcacattaagccgcataccgtatgttgcccgattttgggaacgtgcgcccctccaaacaaagcaagccctgccgctttcacggaaaacggggattcaaccgataaggaaattttgatgaacagactgctactgctgtctgccgccgtcctgctgactgcctgcggcagcggcgaaaccgataaaatcggacgggcaagtaccgttttcaacatactgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaaacacggtgcgagcttcgcgttcaagagccggcagattgtccgttattacgaccccaaacgcaaaaccttcgcctatttggtgtacagcgataaaatcatccaaggctcgccgaaaaattccttaagcgcggtttcctgtttcggcggcggcataccgcaaaccgatggggtgcaagccgatacttccggcaacctgcttgccggcgcctgcatgatttccaacccgatagaaaatctcgacaaacgctgatatgaacctctccaaccactttctcatcgccatgcccgatatggaagacgcgtttttttcacaatcggtcgtctatatctgcaaacacgatgaagacggcgcactcggcatcgccatcaacaaaccctctccgattacgatggacatgattttttccgccaccggcaaaaacatccccatgcggatgcagcacgacagcgtgatgatgggcggtccggtgcaggtcgagcgcggttatgtcgtgcataccccgatcggcaactggcaaagcagtatcggcgtttcagacaatatcgcgctaacttcttcccgagacgtgattgaaaatatttcacgcgaaggtgcggttgacaaagccttgatcagcataggctattcaagctggagcaaagggcagctcgaacgcgaacttgccgacaatgcgtggctgactgttcccgccgacgaacacatcctgttcgacatcccctacgaacaccgttacgccgccgcattcgccaaactcggcatcgacccgctcgccctgttttcaggagccggccatgcataaaattccaaaaggaacggcactggcattcgacttcggcgaagcgcgtatcggcgtggcacaaggagacgcggaattagggctatcccatcctttgagcaccgttaccggcggcagcaacgatgaaaagttcgcggcaatcgccaagctggttcaagaatggcagccgcgttattttgtcgtcggactgcccgtgcataccgacggcacgaaacatgaaatgacgcacctgtcgcgcaagttcggacgcaggctgaacggcaggttcaatctccccgtctattgggttgacgaacggctgtcgtccgtctatgccgaaagcctgctttcggaagcacaggtcttcggcaaaaaacgcaaatcggtgctcgaccaagtggcggcgcaagccatcttgcacggttttttcgagggcggtccggcggaatgtttcaacgggcgtgagggttaagcggcgcggttaacaccctaccgtgaaagaggcgcgcaccaagccgtccagctccaatgccaaattgtcccccgcaccgattgcgcccacgccggagggcgttccggtaaacaccaaatcccctttccccaaaccgtaatctgccgccagtttgtgtaaaatttcccgaatcgggtaaatcatcaaaccggtatccccgcgctgtttcaatacgccgttttgttttaatgaaaacaacaccttctcgggattgccgattctgcctgccgccgcaaaatccgacacgcacgcggaatgcctgaacccttttgccttcagccagggcagccctttttccttcagacggcattggatatcccgtgccgtaaggtccagccctacaccatatcctgcgacacatcccaaaatatctttaccctcgcccgtgccgtctgaatccttaccgaccagcagcacgagttcgcactcaaactgcacatccctactaaactcgggcagcaagattgtaccgccgctgttcaaaatgctgcctgacggcttcataaacaccacaggttcggaaggtatttcgttttttaactcttcgatatgtgcggcatagttcctgccgatacagaaaatattgccgacctcgactgcctctccttctaaaaatactgaagccacttcactttccccctaagtaaaaatgccgtctgaaattattttcagacggcattcgaccaagcttacgcatttaatgaagctgttacacgtgcaacaatttctccgattgcaactgcctgcgcttcgttgtcgcggcgttcggcgtattcgacattgccttctttcaaggcgcggtcgccgatgacgatgcggtgcggaatacccaacagctcggaatcgttcagcaacacgcctgcgcgttcgtcgcggtcgtcgaggaggacgtctgcgcctgccgccagcaattcggcatagattttgtcggcggcttcgcgtacggtgtctgattttttgtagttcatcggcacgataacgacttcaaacggcgccattgctttggtccagatgatgcctttttcgtcgttattctgctcgatggcggcggcaacgacgcgggtgatgccgatgccgtagcagcccatttccataatttgcgatttgccgttgttgtcaaggaagcttacgttcatggcttgggtgtatttgtcgcgcaattggaaaacgtgtccgacttcaatgccgcgcgccagtttcagacggccttgcccgtcggggctttcgtcgccctcgacgacgttgcgcaaatcgacaaactcaggttcggcagcgtcgcggccgaaattgaagccggtatagtggtagtcgtcttcgtttgcgccgatgacccagtccgcgcctttttcggtagcgaaatcggcatagactttgcctgcaaaaccgacagggccgagagagccgccgtttgcgccgaactgttcgacaatcgcggcagggcttgccatcgtcagcggcgatttcacgcccgcgagtttctcggctttgatgtcgttaaattcatggtcgccgcgtaacagcagcaggataagttcgccttcgttttcgccttcaaccacgatggatttcagtgttttttcaatcggaatactgaggaaatcaaccaatgaatcaatggttttgacgtttggcgtgtgtactttgacgagttctgcctgagcggctgcacgttcgcctttgagcggcaaggtcggcgctaactcgatattggcggcgtaatcggaagtgtcgctgtatgcaatcacatcttcgccgctttccgccaacacttgaaactcgtgcgaaccggtaccgccgatgctgccggtatccgcagcaacgggtcggaacgccaagcctagtcgggtaaagatgcggcaataagcatcatacatatcttgataggtcgtctggagcgaggcatagtcggcgtggaaggaataagcgtctttcatcacaaactcgcgcgcgcgcatcacgccgaagcgcgggcgcacttcgtcgcggaatttggtttggatgtggtaaaagtttttcggcagctgtttgtagctgttgatttctttgcgcacgatgtcggcgatgacttcctcgcaggtcgggcccatgcagaaatcgcggtcgtggcggtctttcaggcgcagcagttctttaccgtaaaactcccagcggccggattcctgccacagctcggcaggctgcaccaccggcatcagcaactccacgctgcccgcgcgcgccatttcctcgcgcacgacgttttcgactttgcgtaacacgcgcagccccatcggcatccaagtataaagacccgatgcgttggccttaatcaggccggcgcgaatcatcagcttgtggctggcaagcgcggcttcggcaggggcttcttttaaagtagagataaagaattggctggctttcataaaagtatttttccaaacaggcaaattcaaaagtaaatcgggtgcagattgtaacgcgaaaaaagcaggttttgcaccaacctccaaaattcaccccctgccccaagcgcgggacaaatcccataacagacggcaaaaacatgaccagaaacatcatattgaacataagcacatgatttttatagatttaaatgtgcctattttttaatcaaaataagcgtacatttgttgcgtaagacttttttaacacaagccgtggcttatcaacacggttatccacaaagcttgtgtatagattttctacaataggaaaattgccgacagagacataatgattcgatataccacaattccgaaaaaatatcgccaaaatcaaacagaatatttcgaaatcaaaaagacttgaccttaccaaacgccaacttcagtataaaacctgcttttacaggcatggttatttgccagcagacccgattgctgataggatttcgtgtggagcagatcgaacatttttttcaagttttcccttgtttccaaaacttttataattttttgaaaacattaaacttaaattatttttttcggtttgatttagaaattttcgtttttgcttattatttttcacaaacgaaaataaaggggttggctacaccctccctgccgattaaacactcaacataaaggatagatactatgtccacccaattacacgatgttgaccctatcgaaacccaagagtggctggacgcgttaagctccgtcctcgaatatgaaggcggcgaacgcgcgcaatacctcttggaaaacctggtcaaatactgccgcgacaagggcgtacgtatgccacacggcacgaccaccccgtatttgaataccgtttcggttgaaaacgaaaaaggcattccgggcgaccaaaacatcgaacaccgcatccgcgcattcgtgcgctggaacgccgccgccatcgtattgcgcgccggcaagaaagatttggaactgggtgggcacatcgcatctttccaatctgccgccaccatgtacgaagtcggtttcaaccacttttggaaagccaaaggcgaaggcgaagaaggcgatttggtcttcttccaaggtcacgtcgccccgggcatctatgcacgcgcattcgtcgagggccgtctgaccgaagaccagctgaacaacttccgccaagaagtggacggacacggtctgccttcctatccgcacccccacctcttgcccgacttttggcagttcccgaccgtatccatgggcttggggcccatcatggcgatttatcaggcgcgtttcctgaaatacttggaatcgcgtggtttggcaaaaaccaaaggccgtaaagtatggtgtttctgcggcgacggcgaaatggacgaacccgaatctcaaggtgcaatcgcactggctgcacgcgaaggcttggacaacctgattttcgtcatcaactgcaatctgcaacgcttggacggtccggtacgcggcaacggcaaaatcatccaagaattggaaggcaactttgccggcgccggctggaatgtcgtcaaagtcatttggggccgccgctgggaccgcctcttggcgaaagacaaagacggtatcctgcgccaacgtatggaagaatgtttggacggcgactaccaaacttacaaatccaaagacggcgcgtatgtgcgcgaacacttcttcaatacgcccgaactgaaagcattggttgccgatatgaccgatgagcaactctgggcattgaaccgcggcggccacgacccgcaaaaagtgtacaacgcctacgaccgcgcagcgaaccatgccgacggcaaacctaccgtcatcttggcgaaaaccattaaaggttacggtatgggcgcatccggcgaaggtcagaacgttgcccaccaagccaaaaaaatggacaaagcgtccctgaaacaattccgcgaccgctttgacattccggttaccgacgaacaaatcgaaagcggcgatctgccttacctgacttttgcccccgatacggaagaatacaaatacctgcacgcacgccgcgatgctttgggcggctacctgccgcaacgcaaaccgacgcaggaagtattggaagtgcccgagctgtcagcattcgacgcacaactcaaatccagcggtgaacgcgagttctcgaccacgatggcattcgtccgcatcctgtccactttactgaaagacaaaaaaatcggcaaacgcgtcgtacctatcgttcccgacgaaagccgtactttcggcatggaaggtatgttccgccaatacggtatttggaatccgaaaggtcagcaatatacccctcaagacaaagaccaactgatgttctataaagaatccgttgacggtcaaatcttgcaagaaggtattaacgaaccgggcgcgatggccgactggattgcggctgcaaccagctacgccaacagcaacttcgccatgattccgttctacatttactattctatgttcggtttccaacgtatcggcgacttggcttgggcggcgggcgatatgcacgcgcgcggcttcctgctgggcggtactgccggccgtacgacgctgaacggcgaaggcctgcaacacgaagacggccacagccacatccaggccgacctgattccgaactgcgtatcttatgacccgactttccaatacgaagtcgccgtcatcgtacaagacggtctgcgccgtatgtatgccaataatgaagacgtgttctactacatcaccctgatgaacgagaactacacccatccggatatgcccgaaggtgcggaacaagacatcttgaaaggtatgtacctgctgaaagccggcggcaaaggcgataagaaagttcaattgatgggctccggtaccatcctgcaagaagtcattgccggtgccgagctgctgaaagccgacttcggcgtagaagcagacatctggtcttgcccgtccttcaacctgctgcaccgcgacgctgtcgaggtagaacgcttcaaccgcctgcatccgctggaagccgaaaaagtacctttcgttacttcccaactgcaaggtcatgacggtccggttattgccgctaccgactatatccgcagctatgctgaccgtatccgcgcctacatcccgaacgactaccacgtcttgggcactgacggtttcggccgttccgacagtcgcgccaacctgcgccgcttctttgaagtggatcgctacaacgttgccgtggccgcattggccgcattggcggaacaaggcaaagtcagcaaagaaaccgttcaacaagccattgagaaatacggcatcaaagccgattcagctcctagctggaaacgctgattgatgtttcagacggcctgtttgccccattccgacatcaggccgtctgaaaaccgaatgcccgaatggtttgagcagacaaaccgtaccgatgccgcctgaagcagctttcagacggcatccaatgaaaaagattaaaggaactcaaatgagtatcgtagaaatcaaagtccccgatatcggcggtcacgaaaacgtcgacatcatcgccgtagaagttaaagcgggcgacaccatcgccgttgacgacaccctgattacactggaaaccgacaaagccacgatggatgtgcctgccgatgcggccggtgtcgtgaaagaagtaaaagtcaaagtcggcgacaaaatctccgaaggcggcgtaattctgaccgttgaaaccggtgccgccgccgccgaagccgccccggctgctgccgaagcacaacctgcacctgctgccgcacccgctgccgcaggcggtgcaaccgttcaagtagccgttcccgatatcggcggccataccgatgtggatgtaatcgccgttgaaatcaaagtgggcgacaccgttgccgaagacgacacgctgattactttggaaaccgataaagcgacaatggacgtaccttgtaccgctgccggtgtcgttaaagccgtattcttaaaagtcggcgacaaagtatccgaaggctctgccattatcgaagtagaaaccgtcggctctgccgcagcagcccctgctcaagccgctcaagctgccgcaccggctgccgctccgcctccgactgctgccgccgcacccgccgccgcgcctgcaccttctgcacctgccgctgccaaaatcgacgaggccgctttcgccaaagcacacgccggtccttccgcacgcaaactggcgcgcgaattgggcgtggatttgggccaagtcaaaggcaccggcttgaaaggccgtatcatgggcgacgacatcaaagcctttgtgaaatccgtgatgcagggcggcgcggcaaaacctgccgcagccagcgcatctttgggcggcggtctggacttactgccgtggcctaaagtggacttctccaaattcggcaatgtcgaagttaaagaattgtcccgcattaagaaaatttccggtcaaaacctgtcccgcaactgggttgtgattccccacgttaccgtacacgaagaagcggacatgaccgagctggaagaattccgcaaacagctgaacaaagaatgggaacgcgaaggcgtgaaactgtccccgttggcgttcatcatcaaagcctctgtttccgcgttgaaagcattccccgaattcaacgcctcactggacggcgacaacctggtgctgaaaaactacttcaacatcggtttcgcagccgatacgccgaacggcttggttgttcccgtcatcaaagacgtggatcaaaaaggcttgaaacaaatcagccaagaattgaccgaattgtccaaaaaagcccgtgaaggcaagctcaaaccgcaagaaatgcaaggcgcgtgctttaccatttccagcttaggcggcatcggcggcacaggcttcacgccaattgtgaacgctcccgaagtcgccatcttgggcgtgtgcaaatcccaaatcaaacctgtttggaacggcaaagagtttgccccgcgcctgatgtgcccgttgagcctgtccttcgaccaccgtgtcatcgacggtgcggccggtatgcgcttcaccgtattcttggcgaagctgttgaaagacttccgccgcattaccttataaaataaaacatccctctcaagcagtctgataatgtttggattgcttgagattgatgagtaatggtgttaaattcaacctttaaattaataacttatgggaaatttcttatatagaggcattagttgccaacaagatgagcaaaataatggacagttaaaacctaaaggtaataaagctgaagttgcaattcgttatgatggtaagtttaaatatgatggtaaagctacacatggtccaagtgtgaagaatgcagtttacgcccatcaaattgaaacaggtctatatgacggatgttatatatctacgacaacagacaaggaaattgccaagaaatttgcaacaagttccggcatcgaaaatggctatatatatgttttaaatagggatttgtttggtcaatattctatttttgaatatgaggttgaacatccagaaaacccaaatgagaaggaagtaacaatcagagctgaagattgtggctgtattcctgaagaagtgattattgctaaagagttgatagaaattaactaagttgaaaggtcaatataatggctttagttgaattgaaagtgcccgacattggcggacacgaaaatgtagatattatcgcggttgaagtaaacgtgggcgacactattgctgtggacgataccctgattactttggaaaccgataaagcgactatggacgtacctgctgaagttgcaggcgtagtcaaagaagttaaagttaaagtcggcgacaaaatctctgaaggtggtttgattgtcgtcgttgaagctgaaggcacggcagccgctcctaaagccgaagcggctgccgccccggcgcaagaagcccctaaagctgccgctcctgctccgcaagccgcgcaattcggcggttctgccgatgccgagtacgacgtggtcgtattgggtggcggtcccggcggttactccgctgcatttgccgctgccgatgaaggcttgaaagtcgccatcgtcgaacgttacaaaactttgggcggcgtttgcctgaacgtcggctgtatcccttccaaagccttgttgcacaatgccgccgttatcgacgaagtgcgccacttggctgccaacggtatcaaataccccgagccggaactcgacatcgatatgcttcgcgcctacaaagacggcgtagtttcccgcctcacgggcggtttggcaggtatggcgaaaagccgtaaagtggacgttatccaaggcgacgggcaattcttagatccgcaccacttggaagtgtcgctgactgccggcgacgcgtacgaacaggcagcccctaccggcgagaaaaaaatcgttgccttcaaaaactgtatcattgcagcaggcagccgcgtaaccaaactgcctttcattcctgaagatccgcgcatcatcgattccagcggcgcattggctctgaaagaagtaccgggcaaactgctgattatcggcggcggcattatcggcctcgagatgggtacggtttacagcacgctgggttcgcgtttggatgtggttgaaatgatggacggcctgatgcaaggcgcagaccgcgatttggtaaaagtatggcaaaaacaaaacgaataccgttttgacaacattatggtcaacaccaaaaccgttgcagttgagccgaaagaagacggcgtttacgttacctttgaaggcgcgaacgcgcctaaagagccgcaacgctacgatgccgtattggttgccgccggccgcgcgcccaacggcaaactcatcagcgcggaaaaagcaggcgttgccgtaaccgatcgcggcttcatcgaagtggacaaacaaatgcgtaccaatgtgccgcacatctacgccatcggcgacatcgtcggtcagccgatgttggcgcacaaagccgttcacgaaggccacgttgccgccgaaaactgcgccggccacaaagcctacttcgacgcgcgcgtgattccgggcgttgcctacacttcccccgaagtggcgtgggtgggcgaaaccgaactgtccgccaaagcctccggccgcaaaatcaccaaagccaacttcccgtgggcggcttccggccgtgcgattgccaacggttgcgacaacggctttaccaagctgatttttgatgccgaaaccggccgcatcatcggcggcggcattgtcggtccgaacggtggcgatatgatcggcgaagtctgccttgccatcgaaatgggctgcgacgcggcagacatcggcaaaaccatccacccgcacccgaccttgggcgaatccatcggtatggcggcggaagtggcattgggtacttgtaccgacctgcctccgcaaaagaaaaaataaatccgactgaataaacagccgataaggtttatttgagcaaatgccgtctgaaatgttcagacggcattttctattttacagcggattaaaatatcttctccgacctatagtggattaacaaaaatcaggacaaggagacgaagccgcagacagtacaaatagtacggaaccgattcacttggtgcttcagcaccttagagaatcgttctctttgagctaaggcgaggcaacgccgtactggtttaaatttaatccactataaaaacgaatccgacacggcttatctaaaggaatggttgaaaacggcagtttccaatacaacaaaatgccgcctgaacatttcagacggcatttgacccattactgctgcggctctgaaaccataccgccttcatcaaaatccggctccggttcgttttgcaacgttttaccgttcaatttcaactgattgtttttcagagaaatggcagtatcaatctggtcgccgttcaaagtcagatatttttcccttgccatactctgaaccgtactgtccaccatcaggcgcaaggtctcgttgatgtcgtcaagacttgccctgccttccgcctcatcttcggcattgacgctgaaaatattgcctgcttgactgaccgccaagtcttccagcattttttggggaatactcattctgatgtcggcttcggttttcttcagcatcaaacccaattgattcaaatcttccttcttcatgtctttaaacatgatttttccgcccacatcgatttttcccgatggcagcgtgaatcggaaagttttaatgtccaatacgggattgttggtgaacagtccggaagcctctcctttgacggcggcaatcaaatcattgcggatttgttcctcggtcatttttttggcggaaatttgtgcaaacttgcgtttcaatacggttaaggcagaagcatcgaggtgttcggcagcgatatggatgtccagcgggccgtatttttcatcgccgtacaccagtgtatcgaaacggaactgcccttcactgttgataaacgcgcctgattccccggtcttggttgaaaaagccagtttgccgacttcgattttggaaggtgcgatgctgccgttgggattgataaacgcgccaatctgcaaatcggtaacaagattgaccagttcgtttaacttgacgttgtaatcgacaccctctttccattctagggagaatttttccaaggtcagattgctgctgcccaaagcaagcggattgatgccgtctgaagtttccgaatcgaaatgcactttttcaaacgcggcatcgcctttgtctgccagcttgattttaaacaagggggcatcatagccgttccggtagcttttgaaacctttttgataaaccgtttctcccgtcaggccttcccagtgcagccttgatgcccgacagctcttcataatcgaaggcgggaacactgacttccattttaccgctgccgttaaaataaacggtattggcaagggaagccgggacttgttttccaaaaaagcgttccagaactttttccgtttcaggcgcgtatttgaactcggtttcaatgtacgcctgcgtgccgaatccgccggcgaaagggccgtgcgtgatatggttaaccagcgtaaccggctgttccaacactgttttcaggttatccggcaggtattttcgggcattattcagcaactcgggtttcagacggatgaccgtcgtttccatagaggtaaaccagccgcgctcatattggtgcgattcgacggtcaagaagcccgtttcctgcaatattttttgctgctgcgtcaagctttcttcggctttgacacccaaataataaggcgtgcccaaagcaacgccgagcaatgctgccgcaaccgaaatcaaaggttttttcatcacttcaaacaagcaggtttcaaagacgctagaatagcattatttaagcgtatcccgccatatctctttaaaagaaatgccgtctgaaacctgttcggacggcattttccggatatagggaaatcagaaatccaattccgccttcagccagtaagtgcgcggcataccgacgacggcgaagctgcggtcgtattggccgcgctgtacctgccaatagtttttgttgaacaggttttccaccgagctgctgacggtcagagtgtttttgccaagcttggttttgtagcgcgcgcctacgtcaatcaaggtataggacgggaaggcgtattgtttttgcgtgtcttggtcagacttgccgaaatacgaaacattaccgtttaaagtcaagcctttggcaaacggtgtatcccattccaaacctgctttggcaattacgcgcggattggcgacttgtacgccgttaaccagcatatcgcgtgaatttggatactctttcacggtcgattgcagatacatcagacccaaagtcggacgcaaagtattgttgagcaagttcgcgtaggtgttgaactcaataccgcgattgcgttccataccttgctcgtcgccggccgcgccgccttgcgccttatagcgggcgaaatcagaattattgccataggtcagcgttgttgttaccccttttgttgtcttggtagttgtatgaccgcgccagtagcccgggcgtttgatttggaacgcgtttaacgtggttacgaaattgccccagtttttacgcacgcccacttcaaactggcggctgacacgcggtttcgccattgtcgtttcgccggaatcatcggttttgatgtcggcaggctccaagtcttccatatagttgccgtacacaaccaaatcaggttgcggcacccacgccgccatcagcatcgggctgaaacgtttggcatcgccgctctgtgattttttgtcggtatattcgactgtttggaaacgtccgcccaaagtcaggcggtatttgttatccacgaagcccaaggtgtcggacaaagccaggctgttgactttgatattggcatccaagttggcagagttctcccaagaattgggatagtcggctgtaaacgatgccaattgatgctcaatatttccgtttgccttcacttctaccttgctagctccggctgccgttccgcgtgattttttcttattggtgtattcaaccgcttggaaacgtccgcccaaagtcaggacaagcgtccgccggcgttttgaatgtcctgcatacgcgcgcgaccgccgttggttttgcgttttgcgtagatggaatcgaacgctacgcgcagtgtttcgccgcgatagtcggcatttaccgcaaattctttgttgtcttcgctgtaaccgtggcgcggggtgtcgccgtggcgcagtttgccgttggcgcgcacgccgaatgctttgttttcgccgaaacgttggcccaagtcgaacgtaccttgggcgcggttgttgccgaaccgggccaaaccgattttgcggttgccttcatcagcggcttttttggtttcgatattgacggaaccggataccgcgccatcagggttcatgccgtttacggcggtggacgcgccttgaatcagttgtgcggagccgacttgcacgctggtcgtgccttgcgtgccgtacatacctgtcaaaccgttgacgctgaattggcgcgcatcaagctgataacctctgaaatacaatccggtcagcgtgttgctttcgccgccgaactgccaaacggaagcgtcttttttcgctacggcatccaccaaagtacgcgcctcggtgttgttgagggcttgttcgtcgtagttgacgacggtaatcggcgcggtaaaggcgttggctttgcccattcacttggtgcttcagcaccttagagaatcgttctctttgagctaaggcgaggcaacaccgtactggtttttgttaatccactataaacaaatcgtacagggttctccgtttaatcagatatgggtttccatcttcggcagtttcgggcatttagccgtttccaccttcctgcccccgctgccagtaaaaatgccgtctgaaatatcggcgcgatacttcagacggcatacccgcccgttttcccgcattcccgggagcgggctgaaatttaaacgtgtgcggaaatgattttcaacatttgcgccagcactttgggattggcagccacaatatcgccgctttccagccagccgtcttcacccgacatatcggttacgataccgcccgcttcctgaacaatcaatgcaccggcggcaatgtcccacggtttgaggttaaactcgaaaaagccgtcaaaacgtcctgttgctacggcgcacaaatccaaagaagccgcaccttcacgacggccgccggcggtttttgccaagaaatctttcaaaatcgccagatacttgtccatcatgctttgatcgacaacagggaagccggtaccaatcaggcagcggttcagttcgatgcggttggaaacgcggatgcggcggtcgttgagcaacgcgcctttgccacgcgaagccatatatacgtcgttgcgttcgggggcgtaaaccaaagcttcttgcaacacgcctttgtgcagcagcgccatagagatggcgtattggggatgaccgtgaaggaaattggtcgtgccgtcgagcggatcgataatccattcgtactcggctgcggctttgccgtgggagccgctttcttcacaagtgattttgtggtgcggataggcttctttcaaagcctcaaccaggatgatttcggaattgcggtcaacatcggaaacaaaatcgttgaaggctttgctgtcggttttgacggcatcgagattgcccgcggcgcgtatcatcatctgaccggcacggcgggcggctttaaaggctgtattcaaaaacggattcatcagatttccttaagggtggcataccgccggttcggacgtacagtccttcggagcggcaaaatcggagtttatttggttggggtaaatcctgccaaatcgggtaaaataccgcctgacgcgtgtctgcttcaggcgcaacgttaaatttccgacgttgttaaagaacatttcagacggcatttgaccgtccgaacgaaaaagacggcgcattataccctattccattccgaccgaaaaccgaacatgactactctcaaacccgccctgcccgcttatctggacaacatccgcatcatcctcacgcgcaccagccatcccgccaacatcggctctgccgcgcgcgcgatgaaaacaatgggtctgcacaaactgaccatcgtcgccccaaatctgatggcaacgccgatgacggaaaacccgcccgtgtttgacccggagcatcctcaatcgtttaaattaccggaagaaagcttcatcctcgcttccggcgcggcagacgttttggaaaatgccaccattgccgcttctttggacgaagcccttgccgacaccaccatcgcctgcgccctgaccagccgccgccgcgaaattactgcgccgctgcaaaccccgcgcgatttggtatccgaattactgcagaccgcaaaccgaggcgagaaagtggcactggttttcggcaacgagactttcggcttgagcatcgaagaagtccaagcctgcaaccgactgatgaccatcaacggcaatcccgactatttctcgctcaacctcgcccaagccgtgcaggtcgtgtgctacgaaatcttcagccaaaccggttcgcccatgacccatcttcaacaagaagaccacgctgcgacccacgagcaaatcaaaggcatggtcgcccacatggaaagcgtgatgaacgacatcggctttttcaaccgccgcaacggcgagcgtctgatgcgccgtatgcagagcctgttcggccgcgccaatacgcaaaccgaagacatcgatatcctgcgcggttttttcaataccgtcagccaccgtatccataaaaaagactgattaaggccgtctgaaaacatttccagcttttcagacggcatgactgatattcggataagcatgaattacgccctagacgcattatggtggaaacttaccagccaacccgtccgcgaccttgcctcgctgctgactgcgccgcctttgtggcaaagcggctgcgaattgagcgtgcgagaactactgggagaacacggtttccgttaccttttggcattggatgccgatcccacgcggctgacggattacctcgcccaacgcgccccgttcggccaccgtctcggcatttatgccgaagagctgctggctttttggtttgccaatgcaccgcacgccgaactgctcgcgcacaacctcacggtttccggttcggacggcaatacgcaaggcgcggcggattttgtggcaaggcttaacggcaaaccctaccatatcgagctgacctgcaaatattacggcggcgacacggacagtcccgaagggatgcgcggattcgaccccaaagacacgctgttgggaaaagccgccaaactgaccgcccaactcggtctgccgcacacttcagacggcatccggaccttgcggcagcacggtttgccgcttaacgtaaaacccgtttccatcgtgcgcggcatcggattttttccacacggtttccatgcttttgagccaccgcttaatccatacggttggcgcggcatctatattcaagattgggcggaatacgggtttaaacgccaagaagtccgctaccatctgctcgaccgtatggcctacctcgcgcctgcgcgtgtcgccgaaaccgaaacattgaacgcaaccgaaatccgccgtatcgaccaaggcttgattgccgttttggaatgtcggccggacggcttttggcacgaaatcgaacgcattatgaaggccgtctgaaaccctttcccaacattaacgcgtatatctattgagaggcttagtgatggaaatctcatttcccatacaatttatgaaagagtcatccgagttaataaggatattggatatgataaatataacaacaacatgccaactaatattatgacgatccaaacaaataagtatggtaatttaataactacgaccccaggtagaatacaatgaagaataatgttaaaaattggacaactaaagaagtcaagcaatcattagataaatttaataatattttaattaaaaatacttttcttcttcagtatctgaaaaaagagttttcagcttcaagtgcttattgtttgtctatgctccctgaagaagaagatatatatgaaatattggttaatgggaatattattattgatttagaatttaataaacatacaaatgaaacagttgttattaatgttactgatgttgatgaatacttgaaaactttaaccaatgagagtggtagagtattttttacattagcaaaagaaatcggcaaacagaaaaacatttaacaagagcgaaatacaaattaaaaactcaatggagtgatggcatatttaggatagatatactgaacgaagaaaataaattttgtttttttcctcatgttttagggagtgattacaaaatgaaatcgctgatgtgattatatcggatgctgttcaagcgacctgaaaatagaacttttttcaggctgcctttgtagttaacggagaaatttagacaaatcccgattgcgcacttttaacacatctttcttattgcggatagaatactaagtaatgataaagatgctattgttattttaaggacgttagattgattatgaataacccacagtaagagaacccattacattatgaacgccgcacaactcgaccataccgccaaagttttggctgaaatgctgactttcaaacagcctgccgatgccgtcctctccgcctatttccgcgaacacaaaaagctcggcagtcaagatcgccacgaaatcgccgaaaccgcctttgccgcgctgcgccactatcaaaaaatcagtaccgccctacgccgtccgcacgcgcagccgcgcaaagccgctctcgccgcactggttctcggcagaagcaccaacatcagccaaatcaaagacctgcttgatgaagaagaaacagcgttcctcggcaatttgaaagcccgtaaaaccgagttttcagacagcctgaataccgccgcagaattgccgcaatggctggtggaacaactgaaacagcattggcgcgaagaagaaatcctcgctttcggccgcagcatcaaccagcctgccccgctcgacatccgcgtcaacactttgaaaggcaaacgcgataaagtgctgccgctgttgcaagccgaaagtgccgatgcagaggcaacgccttattcgccttggggcatccgcctgaaaaacaaaatcgcgcttaacaaacacgaactgtttttagacggcacactggaagtccaagacgaaggcagccagctgcttgccttattggtgggcgcaaaacgaggcgaaatcattgtcgatttctgtgccggtgccggcggtaaaaccttggctgtcggtgcgcaaatggcgaacaaaggcagaatctacgccttcgatatcgccgaaaaacgccttgccaacctcaaaccgcgtatgacccgcgccggactgaccaatatccaccccgaacgcatcggcagcgaacacgatgcccgtatcgcccgactggcaggcaaagccgaccgtgtgttggtggacgcgccctgctccggtttgggcactttacgccgcaatcccgacctcaaataccgccaatccgccgaaaccgtcgccaaccttttggaacagcaacacagcatcctcgatgccgcctccaaactggtaaaaccgcaaggacgtttggtgtacgccacttgcagcatcctgcccgaagaaaacgagctgcaagtcgaacgtttcctgtccgaacatcccgaatttgaacccgtcaactgcgccgaactgcttgccggtttgaaaatcgatttggataccggcaaatacctgcgcctcaactccgcccgacaccaaaccgacggcttcttcgccgccgtattgcaacgcaaataaaccggtttgaacaaaatgccgtctgaacccttttcaaagcgttcagacggcatttcatcaattatagtggattaacaaaaatcagtacggcgttgcctcgccttagctcaaagagaacgattctctaaggtgctgaagcaccaagtgaatcggttccgtactgtttgtactgtctgcggcttcgtcgccttgtcctgatttttgttaatccactatatttttgggaatctgttttaccccaatatataaagcaccatattaaggcggagtgtcttccccactttgacccgaacccggaaaagacaccgcccaagccaatcctgatgctgccccgacagccaaccattaaggaaatcctaatgaactttgctttatccgtcattatgttgaccctcgcctctttcctgcccgtcccgcctgccggagccgccgtctttacttggaaggacggcggcggcaacagctattcggatgtaccgaaacagcttcatcccgaccaaagccaaatcttaaacctgcggacgcgccaaaccaaaccggcggtcaaacccgcccaagccgacgcagggaagcgcacagacggcgcggcacaggaaaacaatcccgacactgccgagaaaaaccggcagcttgaggaagaaaagaaaagaattgccgaaaccgaacggcagaacaaagaagaaaactgccggatttcaaaaatgaacctgaaggcggtgggaaattcaaatgcaaaaaacaaggatgatttgattcggaaatacaataacgccgtaaacaaatactgccgttaatcggctctagcgcaaacccgatgccgtctgaagcggcacggggtttgtcatttctgccagtaggttttgacgttgacgaactcgtacagcccgaattcggacaattcgcgcccgtaaccggaatctttgactccgccgaaaggcaggcgcaaatcgctgctggtatggcggttgataaacaccgatcccgcctgtattttttcggcaaaccgccaagcgcgttcggtatcggcggtataaatgcaggcaccgagcccgaacggggaatcattggcaagggcgatggcatgttcttcgttttcggcgcgcaaaatcagggcggccggcccgaatacttcttctctccagacgcggcaggcaggatttaccctgtctaaaaccgtcgcgggataaaaccagcctcgcccttgtgggatttttccgccggtcaggcataccgcgccgtttgaaacggcatcttcaacctgcccgtgaaccctgtcccgcaaatcttcgcggtgcagcggtgcaagcgtagtatcgggatgtttggggtcgcccattttcaatttagcgcattcggcaagaaacagcgtgataaaacgatcggctgcggcttcggttacgatgatgcgcttggcggcgttacacgattgccccgcatcgcggaaacgggaataacaggcttctgcggcggcacgctccaaatcagcatcgggcatcacgataaaggcgttgctaccgccgagctccaacacggttttcttaaggtttgcgcccgcgtgtgccgcaaggatgcgccccgtatgcgttgaaccggtaaacgccattgcatcggtatcttcaaccgccttgagcgtgcccgcctcatccagccacacgcctgccagaggaatgccgtctgaagccaaatcgaacagtgcctgactgacgcgtgccacgctgggcgcgggtttgacggcgcacgcgttgcccgcgcacatagcgggaacggcgaaacgcaatacctgccagacgggatagttccaaggcatgacggcaaacaccacgcccaaaggctcgaagcgcacctgactcaaactcgcctgcgtcgcgatggttttgtgggcaagcagttcgggggcaaggcgggcgtaatagcgtatcagttcgatagacttgccgatttccgcacggcattcgtgcaagcagcgtccgacttcctcacacaccatttccgcaaaacgctctttctccgcctccaaacggtcggcaaatttttgcaggcgcgcggcacgttcggttacgcccagttgcgcgaacgccccgccgcgcattttcaaatccgccagccgccgttcaaactccgcataatcttgagcggggcggcggtaaagcgtttcgcccgtaaatacattgacactgtgaaacatcgaatcaacctgccagttgcgggaatatcgttttcagtcccgacacaataatctccaccgataccgccgccagcatcatacccataatgcggtttaaaatcgtcagccccgtcgcgcccagcaggcggctgaccttcccggcaacgattaaaatggcataacaaatcgcactgaccaccaaaccggccgcgataatcaacgcgatgtcgccgtatgttttagccgccgaagcgtaaataatcacggtcgaaataccgcccgggccgatggtgatcggtatggcgatgggcacgacggcaatcgctccggcattgcgggcggggcgcgcctgccccgtttccggctgcgcgccgagattctgcttggcgggattgtcgttgccgttcatcatcgaaatggcgatcagcagcaccaaaatcccgccgccgacctgaaacgaaccgacgctgatgcccaaaaccttcagcagcgtaccgccgatcagcgcaaataccgcaatcacggcaaacacggcaacggcggccgtccgcgcgaccttcctgcgctccttcgtgctgtgcccgttggtcaggtcaaggtaaagcgacaacgcgctaaacggattaatcagcaccaaaaaagccacaatcagcttgccgatttccatgcccaatcccattatttccccctccttcaaacccgtgcggcaggcatccgatgctgcaaattgccgccgcaacggatttttccgttataattaaaaattcaagcaatacgccccatcatacccgaacgacggtatctttaccatcagacaaggatgcttttcatggcactgacacttgccgacgtagacaaaatcgcccgactctcccgactgcacctgactgcggaagaaaaagaaaaatcgcttcaagaattaaacgacattttcactatggtcgaacagatgcaaaccattaacacagacggcatcgaaccgatggcgcacccgcacgaggccgccctgcgcctgcgcgaagacgaagtaaccgaaaccgaccgcgccgccgaatatcaggcgggtgctccggaagtacgcaaccgtctgtacatcgtaccgcaagttatcgaagaataatccgaatatgcttcagacggcatcagcaataccgcccgaagccctttaaggatggaagatttatgacccaatacacattgaaacaggcaagcgtcctgttgcagtccaaacagatttccgccgtcgaactggcaagcgcataccttgccgccatcgccgaaaaaaatcccgccctcaacggctatatcaccatcgaccaagataaaacccttgcagaagcccgtgccgccgacgaacgtatcgcgcagggcaacgcctccgcgcttaccggcgtacccgtcgcctacaaggatattttctgccaaaccggctggcgcagcgcgtgcgcttccaaaatgctcgacaacttcatctccccctacaccgccaccgtcgtccaaaacctgctcgacgaaggtatggtaacgctcggccgcaccaatatggatgagttcgctatgggttcgaccaatgaaaactcattctacggtgcagccaaaaacccatggaatcttgagcacgtccccggcggttcgtcaggcggttccgccgccgtcgttgccgcgcgcctcgcccctgccgcgctcggttcggacaccggcggctctatccgccaacccgcatcgcactgcggcattaccggcatcaaacccacatacggcacggtttcccgcttcggtatggtcgcctacgcctccagcttcgatcaaaccggcccgatggcgcaaactgccgaagactgcgcgattctgttaaacgcgatggcaggtttcgaccccaaagactccaccagcctcgagcgcgaaaaagaagactacacccgcgatttgaaccaaccgctcaaaggtttgaaaatcggcctgcccaaagaatatttcggcgaaggcaacagcgccgatgttctgacggcattgcaaaacaccattgatttgctgaaagcccaaggcgcggaattgattgaagtttccctgccgcaaaccaagctgtccatccccgcctactacgtcctcgcctccgcagaagccagcaccaacctttcacgttacgacggcgtacgttacggacaccgtgccgcccaattcgccgatttggaagaaatgtacggcaaaacccgcgccgaaggtttcggcagcgaagtcaaacgccgcatcatgatcggcacttatgtactgtcgcacggctactacgatgcctactatctcaaagcccaaaaactgcgccgcctcgttgccgatgattttcagacggcatttgcacggtgcgacctcatcctcgcgccgaccgcacccactgcagccccaaaaatcggagcggatgcttcgccggttgaaacctacttgagcgatatctacaccatcgccgtcaacctcgccggactgcccgcattgaccctgcccgcaggcttcagcggcggcggactgcccgtcggcgttcagcttgtcggcaactacttcgccgaagccaaaatcctcggtgcggcgcatcaaatccaactcaacagcgattggcacggcaaacgacccgaatgaagcagaaccgcacctttaccttccccgattttcgcaccgtttacagctatgcgcctttatatcggctgcaacatttaaaatacacattgcgaaaatttttcggaaaaaaagaaatttacgccttcgagcagtttgtcaacgcatcccctatccgtcaggggctgttcctccactgcccgcaaaatgcctatccgctgctgcgcgaatttgttgacaggcgttttaactgcaaacgccgtttagatgcgatgacggcagattttctcatggcggaaaaactgttcggcacagacatcctgcaccaaatggaagactaccgcttccatttggtcttggcgcacctttcagacggcatcagcttgtggctcaaccgcaacgacaactgcgtcgaagaaggcgcgtggtctttatctttgcgcgacgaagcaggcaaccggctgtatatggcgactttcgcctttgtcggcacacacctgctgacagcctccgtacaagggccggcgggtgaagaagccaaagacaccgtccgccgcataaccaaacaactccacggcttgcgtccccaacaactgatggtaaccgccctgcaatatttcgccgccgtactcggcttggacggcgcaatgggcattgcacaaaaacatcaggtcaaactgcgctggaaacttaaaaagcgcgtcaaaatgaattacgacgcattctggcaggaatacggcgcaagtttggaacgggacggctactggcatctcccccaaacccccgcccgcaaagaccttgccgacatcgaaagcaaaaagcgttcgatgtaccgcaagcgttatgaaatgctggacaatatggttgcagagatgaaagacagtctgaaaacagaagcacgcggcatttcagacggcatccaaacggaaaaaccgccccgccggacagcctgacgcgaagactatcgaattgatattttagagaaagaagctcttatgacctgggaaaccgtaatcggcttggaaatccacgtccaattgaacaccaaatccaaaatcttcagcggcgcatcgaccgcattcggcgcagaacccaacgcgcacgccagcgtagtggaatgcgcgctgccgggcgttttgcctgtgatgaaccgtgaagtcgttgaaaaagccatcaaattgggtttggctttagatgcgaaaatcaatcagaaaaacgtgttcgaccgcaaaaactacttctatcccgacttaccaaaaggttatcaaatcagccagttggacttaccgattgtcgaacacggcaaattggaaatcgtagtcggcgacgatgtgaaaaccatcaacgtaacccgtgcgcacatggaagaagacgcaggcaagtccgtgcatgaaggcttgaacggcgcaaccggtatcgacctgaaccgcgccggcacgccgctgttggaagtggtatccgaacctgaaatgcgttccgccgccgaagccgttgcctacgccaaggccttgcacagcttggtaacctggctggacatttgcgacggcaatatggcggaaggctcgttccgcgtcgatgccaacgtatccgtgcgcccgaaaggtcaagaagagttcggcacgcgccgcgagattaaaaacctcaattccttccgtttcttggagcaggcgattaattacgaagcggaagcgcaaatcgagattttggaagacggcggcaaagtacagcaggcaaccatgctgtttgatcccgaaaaaggcgaaacccgcgtaatgcgcctgaaagaagatgcgcacgactaccgctacttccccgaccctgatttgctgcccgttatcatttcagacgcccaaatgcaaaaagccaaagcagaaatgcccgagctgccgaaagaaatggcagcgcgtttcgtggcggattacggcgtgtccgaatacgacgcgcgcctgctgaccgcaagccgtgcgcaggctgcctattttgaagaagccgccaaagaaagcggacaaggcaagctgactgccaactggatgaacggcgaacttgccgccgcgctgaacaaagaaggcatggaacttgccgacagcccgattaccgccccgcgcctcgccgcgctggttggcaaaatcgccgacggcacattaagcagcaagttagcgaaaaaagcctttgaagccatgtgggcagaacccgaagccaccattgccgaaatcattgaaaaacacggtttgcaacagatgaccgacaccggcgagattgaagccatggtggacgaagtgctggcaaacaacgccaaagccgtggaacagtttaaatccggcaacgaaaaagccctgaatgcgattgtgggacaagtgatgaaggccagcaaaggcaaagccaaccccgcgcaggttcaagagctgattaaagccaaactggcttaatccgttatcacacaggtcgtctgaaagcaaagttccaacgaaggtaaaacaggaaataagctttcagacggccttttatagtggattaaatttaaaccagtacggcgttgcctcgccttgccgtactatttgtactgtctgcggcttcgtcgccttgtcctgatttaaatttaatccactataacttaatctgctcaaaccataccaagacatgaaccacaccgttaccctgcccgaccaaaccacctttgccgccaacgacggcgaaaccgttttgaccgctgccgcccgtcaaaacctcaacctgccccattcctgcaaaagcggtgtctgcggacaatgcaaagccgaactggtcagcggcgatattcaaatgggcggacactcggaacaggctttatccgaagcagaaaaagcgcaaggcaagattttgatgtgctgcaccactgcgcaaagcgatatcaacatcaacatccccggctacaaagccgatgccctacccgtccgcaccctgcccgcacgcatcgaaagtattattttcaaacacgatgtcgccctcctgaaacttgccctgcccaaagccccgccgtttgccttctacgccgggcaatacattgatttactgctgccgggcaacgtcagccgcagctactccatcgccaatttacccgaccaagaaggcattttggaactgcacatccgcaggcacgaaaacggtgtctgctcggaaatgattttcggcagcgaacccaaagtcaaagaaaaaggcatcgtccgcgttaaaggcccgctcggttcgtttaccttgcaggaagacagcggcaaacccgtcatcctgctggcaaccggcacaggctacgcccccatccgcagcatcctgctcgaccttatccgccaaggcagcaaccgcgccgtccatttctactggggcgcgcgtcatcaggatgatttgtatgccctcgaagaagcacaagggttggcatgccgtctgaaaaacgcctgcttcacccccgtattgtcccgccccggagagggctggcagggaagaaatggtcacgtacaagacatcgcggcacaagaccaccccgacctgtcggaatacgaagtatttgcctgcggttctccggccatgaccgaacaaacaaagaatctgtttgtgcaacagcataagctgccggaaaacttgtttttctccgacgcattcacgccgtccgcatcataattccccggtataaagaggattcgagctttccgttcagaacacaaaaaacttcccgtccgtgttttccccgtgaaaaaatgccgtctgaaacccgattccggttttcagacggcatatgttttttcctgttcaaggcgacagccgctcgcgtatccagccaccatccagcaaacggtattggatgcggtcgtgcagcctgctcggtctgccctgccagaactcaagcaaatcgggaatcacaatatagccgccccaatgcggcggacgcggcacatgcagaggatgtttgagtccaaccgccgccgcctttgccaccaataccgccttgttcggaataacctcgctctgcgcacttgcccacgcacccaaacggctctgatacgggcgactctcaaaatattcgtccgacaacttctccgccagcctttcaacacgcccttccacgcgcacctgacgctccagctccggccaaaaaaacgtcatcgccgcaaatggatgagcatccagcgaacgccccttgcggctgtgataattcgtaaagaaaacaaaaccttcagaattaacttccttcagcagcaccatacggctgttgggcctgccgcgtccgtcaaccgccgccacattgaccgccgtcggctcgttgacctgtgcgcgtaccgcctcgtccaaccaccgctcgaactgctcgatcggattatcggcgcaatcggcttccgacaattcccgtttgctgtaatcttcccgaatattgtgcaaatccatttactgctcctcttatcatttgaaagattctactcccgcacgcaaaccgatttcaaccgtcgcacaaactttgccccgaccccaagccgcagcgacgatttcatccgcaaaaccgccgcatcaggtacaatatcgaaccgtccgaccgaggacggcattttatcaacccgtcctgccgcacacgccgcagaagaaccgccttatcaggcgagttaggaaaaatgatgtccaaacagcccaccagcaaacgccaatggcgcgacggcgcagccccgtctgccaagaaaaccgccaaaccgttcaaaagcaaagcccgtcccaaagatgaaacgggcaaaaccgcttcccaaccttacggacaaaaagcttcagacggcatcaaacctcaaaacgtccccaaacagcgcgccgccaaagccaaaaaactcgtcgtccgcaatcccaaccaaaaaattatggaacacgcgcgcgatttgaaagaacgccgcagcgacctgtcgcgcatggaacccgaacgcctgcaaaaagtgcttgccgcgtccggcgtcggctcgcgccgcgaaatggaagaatggattaccaacggctggataacggtcaacggcaaaaccgcgcaactgggcgacaaagttacccccgacgaccacgttaccgtcaaaggcagcatcatcaagctcaaatgggcggaccgcctgccgcgcatcatcctgtattacaaacaagaaggcgaaatcgtttcccgtgacgacccgcaaggccgcgtcagcatattcgaccgcctgccgcaggccgccagcagccgctgggtcgccatcggacgcttggacatcaacaccagcggacttctgattcttaccacctccggcgaactcgtccaacgtttcgcccaccccagcttcgaagtcgaacgcgaatacgccgtgcgcgtcttgggcgggctgaccggcgaacaaatgcgcgtcctcaccgaagaaggcgtgatgctcgaagacggcttggcaaaagtcgaacgcatccgcgaacaaggcggcgaaggcgcgaacaaatggtacaacgtcgtgattaaagaaggccgcaaccgcgaagtgcgccgcatttttgaaagccaaggactcaccgtcagccgcctcgtgcgcatcggcttcggtcccatcggactgcccaaccgcctcaaacgcgggcagttctacgaactcaaccccgccgaagtcgccaacatcatcaaatgggcggacatgctgctgccgggcgaacgccgccgcaaaaaagcctaaacccgccaaaacacaaaaatgccgtctgaaacatctgctgtttcagacggcattttattcgggcgttttcaggagaaaaggtcgagtgctttgacaaagaccatcaccacgccgtaggcgagcggtatgacggccaatgcccaacgccaccagaccgatatgccgccgccggaaactttttcgcccacaaggtaagcgtcggatatggcggtttcgtcatcggggttgccgctgtgtgcggcggttttgatgtctttttcgtggtgtttttcgtgtacggatttgacggcgaggttgcacaacaaaccgataatcagcaggcacgccatgatgtacatggttacgctgtatgcctgtgccgccggtatgccgctgtcgatttggctttggcgtatgtaattgaccagtaccgggccgatgacggcggcggttgaccaggccagcaggatgcgtccgtgaatcgcgccgacctgataggtgccgaacaggtctttcaggtaggcgggaatggcggcaaatccgccgccgtacatggaaataatcacgcaaaagccgatgatgaacagggctttgctgccgccctcgccgatggagggaacggcgaaatacagcagcgaaccgagtacgaagaagatggtgtaggtgtttttgcgtccgattttgtcggaaacgctcgaccacaaaaagcgtccgcccatgttaaacaggctcaggaggctgacgaagcctgccgccgcacctgcgccgactgctgcctgcctgcctatggaggtttcggaaaagagttcctgaatcatcacggatgcctgacccaatacgccgatgccggcagttacgttcaggcacaatacccagaacaacagccaaaactgcggcgttttcatggcttgggacacgttgacatgattgctgctgaccagcttgttttgcgttttcggcgcggtatagccttcaggtttccagccgtcggcaggtacgcggatggtaaacgcgccgaacatcatcagtgcgaggtaaagcagacccaatacggcgaaggtttcggcaaccccgaccgaagcagcgtttgaaaaggtgttcatcagtgatacggaaagcggcgaggccagcattgcgccgccaccgaaacccataatcgccaaaccggtcgccatacccggcttgtcgggaaaccatttcatcagtgtggaaaccggcccgatgtagcccaaacccaagcctacgccgccgatgacgccgttgcccaaatagagcaggaagaggttgtgcgtacgcacgccgaatgcggatacgaagaagcccaggctgaagcagcaggcggcggcaaatatggctttgcgcggccctacccgttccatccacgtaccgaacagggcggccgacgcgcccagcatcgcgagtgcgatactgaaaatccaacctacggtcgtcagcttccaatctccggccgccgattcggttatgccgataagtttggtcagcggcgcgttgaatacggaataggcgtaaatctgcccgatggcaaggtgtaccgccaatgctgcgggcggtacgagccaacggttgaaacccggcttggcaatgcttgcctcacggtctaaaaacttcataacatcctctttctgtcagttgaaaaataaaatttcatttgcccaatggaaacttattgaaaattataaaaaaatatcgggtcgggtttttatccgccccaagatgcgccgtctgaaacatttcgggtgtacggaaaggtttctgttttttccgacaaattcctgcggcttttcgcttccggattcccgctttttcaggaatgacgaattaaagattatcttaaggtcaagggactggattcccgctttcgcgggaatgacggcggcgggggagcggtttttccgattgggtttaaatgcaatcgaacaaatcctgctgcccttgttctttgcttacgcgcacgtcggtttcgccgtcggcgaagataatgtgcagcttctgcccctgcttcaaaacatcggcgttgcggatgacttgtccgcgtgtgtttttgacgacggaaaagccgcgctccagaatgtgctgcggcgaaacggcttcgagcaatgcggcttgggcagtcaggctttggcggcggtgggtaagcagttggtggaaggcgtgcgacagggccgtctgaaagcggtcgatgttttttttgcaaacggaaacatcaggacggcaatgtttcagggcttgggtttggcgttcgaaacgggcggtgtgggtacggacgttttgcgtcatcgagtaagacagcgtttgcgccagcttgccgattgaagcgcgctgttcgtcgagtttttggcgcggatgacggatttgccgcgccagccagtcgagtttttggctggcatcgaaatagcgttgttccaaaacggttttcagacggcattgggcttgggcgaggcggtgcagcgattcttggcggttggggctgaccagttccgccgcaccggtcggcgtgggcgcgcgcatatcggcgacgaaatcggcgagcgtgaaatcggtttcgtggcctacgccgctgacgaccggaaccgtgcaggattcgatggcgcgcacgaccggttcttcgttaaacgcccacaagtcttcaatgctgccgccgccgcgacagacaatcaacacatcgcattcggcgcgttgcgaggcggttttaatcgcttgggcaatttgcaattcgctgcctgcgccttgaacgggtgtcggataaacgataacggggatttcgggtgcgcggcgtttcaaggtagtaacgacatcgcgcaaagccgccgccgccagactggttacgatgccgatacattgcggacggacgggcaaaggtttcttgcgttccgccgcaaacgcgccttccgcctgcaactgcgccttcaaccgctcataggcttcgtaaagctgccccaaacctttgagccgtacttcgtttacggtaatctgaaattcgccccgcgcttcataaatactgatttttcctgatacctcgatatggtcgccttctttcaaaggcttcgccaaacgcaccgccgcacccttgaacatcgcgcaacgcacctgtgcgcggctgtctttgagcgagaaataataatgcccgctggcggcacgggtcaggttggatacttcgccggcaatccacaaaccggcaaggtggttttccaaaagacttttggcaaatgcgttcaactcggaaacggacaacacgtcagaatgaaaaaaatcagacatcgaatcaatcaaatagtaaaaaatatgaatatgttttgaagcctaaggcggcaccgggccgcctaaattgtcaacaatattataacacgcgccatcttgccgcccgccttttcccgtatgacttttttaagcggggaatgggaaaaatattcatcaacctgcctgcaatctattcaaattgcaccgccggcaggctatgatgcggatattttcgacaggaggaaaaatggatacgcaggcagttatcacacatatcgcccgatggttggacgaatacgccgcccgggcaaatgcaaaagggtttgtcgtgggcgtttccggcggcatcgattccgccgtcgtctccgcactcgccgcccgcaccggccgccccacgctgcttctggatatgccgatacgccaacaccccggccagcttgagcgggcaaggctgcacatccgcaatctgcaacggcaatatgccaatgtaagcgcgcaaacggtcgatctgaccgacaccttccagacctttgaacaaaccgtcggtgctcatcagacggcatttgacagtcagccgctttccctcgccaacgccagaagccgcctacgtatgctgaccctgtactactacgggcagatacacggactgctggttacggggacaggtaataagattgaagatttcggcgtgggcttttttactaaatacggcgacggcggcgtggacatcagcccgattgccgacctgaccaaaacgcaggtttaccggcttgccgaagcattgggcgtggacgaggcgattcaaaaagccccgccgaccgacggcctgtgggatacggaacgcaccgacgaagaacagatgggcgcaagctatcccgaactggagtgggcaatgggcgtgtacggcacgcgcaaacccgaagattttgaagggcggcagcgcgaagttctagaaatctatacgcgacttcaccgcgccatgcagcacaaaatcaacccgattcccgtatgccgcattccgcccgaattgctgggctgaaacacggaaatgccgtctgaaacggaaaaccgtatttcagacggcatggaaatatccgactcctatcccttaagaatcgagtacgcgggcaaacaaaatatcgttttccaaatgaatgtggtcgttcaaatcctccaccatttctttcgccagcgcgtaaagccgcgtccagcttccgcaagccccttctggcggttggaaattgtcggtcagctctttgagccgtgcgatggcgcggtcgtgttcttcgtgttcgtgcatcatcacgccgatgggcatcgccgcaccgcgtccgacaccctgattaatcatcggaaacagcatcctttcctctttcatcatatgcatcagcagttcgttctgcatataggcaagcagctcggcaatttccgccggaaaggtgtcggcatgaacttgggccactttttgcgccagcggcaccaattcttcaaattgtgcacggtggacattgtggtagcgttgcaggatatgatcgacggttgcaccaaagggggcggtctcccaaacggaaaaatcagtcatcgcagtgttccttttacagggtttcgggtttggttttgaacattcatactttaagaatcaattcaaacggagcatacaccgcccgcgcgcttctgtacagcgtcaaacgtattccttacattttgctaataaaagtaattttcagaaataaaatactgtccgaaccgttttttagaatttgcaaaggcgattggggcggtacagaaaaactattatcccgcccgcccacttgaaatttttatgcccaagccctatcctgcacgctatcgtgccaatcccaaccgaaaaggaaaaataatgagcagc

SEQ ID NO: 37801 - DNA, 20352 bp, Neisseria meningitidis
ttataatgaatcataactatcaaatatatcgttaaactggatggattaaatacctttaaaatgcagcttaacctacatcaataaagtgccacaaaaagggaaaattggaaactaaagcaatggcggtcgggttgtaatttattataacaatatgatttatatgtaataaaaaacagattaagcaaagggctcgtcggcggtgcgaatgtaattccgcttggcgtaataaggcagatatgttaaatttagaaaaaattacgcttgcccggattgcaccttaaacaggctgcggaagcggcaggataaaaatctttattcccataaattcatggagactctcatggacacacaaacttacaactacaaagtggtgcgccagttcgccatcatgactgtagtttgggggattgtgggtatgttggtcggcgttatcgtcgccgcccagctttttgctcctgccctcgacttgtctaatatcggaccttggttccacttcggccgcctgcgtccgctgcacaccaatgcggttattttcgcatttggcggttgcggcctgatcggcacatcatactacgttgtccaacgtacttgtaatacccgtcttttcggcggttggctgccggcatttaccttttggggctggcaggcggtaatcgttgccgccgtcgtcagcttccctatgggttggacccaaggtaaggaatatgccgaactggaatggccgatcgatattctgattactttggtttgggtggcttacgccatcgtattcttcggtacgattgccaaacgtaagattaaacatatttacgttgccaactggttctacggcggctttattttggcggtcgcacttttacacatcgtcaacaatatcagcatcccggccggtttgatgaagtcataccccgtctattccggtgcgattgatgctatggttcaatggtggtacgggcataatgccgtgggcttcttcctgactgccggcttcttgggtatgatgtactatttcgtacccaaacaagcagcccgccccgtttactcctaccgcctgtccgtcgttcacttctgggcgttgatttttacctatatgtgggcgggtccgcaccatcttcactacactgcgctgcctgactggacgcaatctttgggtatggttctgtctttgattctgttcgcaccctcttggggcggtatgattaacggcatcatgaccttgtccggcgcgtgggacaaactgcgtacagacccgattcttaaattcctgattgtatccttgtccttctacggtatgtctacctttgaaggcccgatgatgtcgattaaaacggtcaatgcattgagccactatacggactggaccgtcgcgcacgttcatgcgggtgcgttgggctgggtaggctttgtaaccatcggttccgtctattacatgattccccgtctgttcggcaaagaacagatgcacagcaccaagctggtagaagcacatttttggattgcgaccatcggcgtggttctgtatatcgctgccatgtggattgccggtgtgatgcagggtttgatgtggagttctttgaacgatgacggtacgctgacctactcgtttgtcgaatccgtaaaacgcaccatgccttactacgtgatccgttttgcaggtggtttattgtatctgagtggtatgtgcattatggcgtacaacgtgtaccgcacagccatcggtggtaaagcagtcgatgccgaaatccctgcggtttcccaaacacagcaccactaaaatactaagaaagataggctaccaaaatgaaattacaacaattggctgaagaaaaaatcggcgttctgattgtgttcacgctgcttgtagtcagtgtcggtctgttgattgaagttgtgcccttggcctttaccaaggcggcaacacagccggcgccgggcgtgaagccttacaatgccctgcaggttgccggacgcgatatttacatccgtgagggctgttacaactgccactcgcaaatgattcgtccgttccgtgcggaaaccgagcgttacggtcattactctgttgccggagagtcggtttacgaccatccgttccaatggggttccaaacgtaccggtcctgatttggcacgtgtgggcggtcgctattccgacgaatggcaccgtatccacctgctgaatccccgtgatgtcgtgcctgagtccaatatgccggcattcccgtggcttgcacgcaataaagtcgatgtcgatgcaaccgttgccaacatgaaggctttgcgtaaagtaggtactccttacagtgatgaggaaattgcgaaagcacctgaggctttggcaaacaaatccgagctggatgctgtagtcgcctatctgcaaggattgggtctggctttgaaaaacgtaaggtaacatcatggatattaacggtattcgtgctctcttcacggtatggatctttatctgtttcctgttggtactctatatcgtcttcaacaggcggaataagaaaaactacgataatgccgcaaacagcatttttgatgaaaaccaagatgcgcaagataagaaaagcgaaaaccgttaatattgtgataacggagcaaaacaatgaacacaacatcccaatttaccagtaatttctggaatatatatattgcagttattgtcttactgagctttatcgctttggcttggctgctgctgtctcaaaatgttgtcaaacgtccgaagaagggcgaagaagtacaaactacgggtcatgagtgggacggcattgccgaatacgacaatccgctgccccgctggtggttttggctgtgtgttttgacgtggctgttcggtatcggttatttggttatgtatccgggtgtcggcgactacaaaggtctgctgaaatggaccagccataaccaatatgaaaaagaggtcaaaaaagccgatgagcaatacggcaaactgtatgccaagtttgcggatatgccgattgaaaaagtggcaaaagaccctcaagccaagcaaatcgcccaaaacctgtttaacacttattgtatccagtgccacggctctgatgctaaaggctctaaaggttttccgaatctgaccgatagcgattggttgtggggcggtgatcccgataaaatccacgagaccatcgaaaaaggccgtgttgcgactatgcctgcctggggtcctgctttgggcgaagaaggcgtgaaagacgttgcccattatgtgatgtccctttcaaaacccgaaggtcagtatgatgaggaacgtgccgcgcgcggacaagccttgttcagcggtccgcctgccaactgtttcacttgccacggcgataagggacaaggtatccaaggtttgggtccgaacctgactgatgacgtgtggttgtggggcggtacgcaaaaatccattatcgaaaccattaccaacggtcgcagcagccaaatgcccgcttggggacatttcttggataaagacaaactgcatattatgactgcttatgtatggggtctttccgataaagacggtaaagctccggtgaaaaaagccgagcctgcaccgactcccgcaccggcggcagaacccgcagcctctgctcctgcagaagcagcacaagccgtgtccgaagccaaacctgccgcagcagaacctaaagccgaggaaaaagctgcacctgctgccaaagcggacggcaaataggtttatgaaaccgtttgtgccgcctgccatggcaatgcgattccgggtattccccatgtaggcatcaaagccgattgggccgaccgcatcaaaaaaggcaaggacacgttgcacaaacacgcgatcgaaggtttcaatacgatgcccgcaaaaggcggtcgcggcgatttgagcgatgatgaggttaaagctgcggttgactatatggtcaaccagtcaggcggcaaattctaacttgactgagtttccgatattatcggttatgaaaatccagattcagtattgaatctggattttttgttttaacgggcatccggttttaaacgcagactgcctatttgttgtaatgaattttgactttagtcataaagaattagtctttattgtttataatcgcgcatcatcacgatagccctattttcaaaaggacgattaatggatacacaaatcaaaactgaagccgacaatcagagcaaccggcgttatctgaccgtttggcggtggcatttttatgccggtctgctggttatgccttttcttaccctgcttgccgttacgggtttgggtatgctgctgtttgccaatattaccggtaaggagggcgagcggattcatgttgtgccgcaggcaacggtacaacctctgtctgttcaggcggaagcggcacgcagtgccgttaatccggaaacttcgtccgtcgttcagtatattgcgccgcgtgccgatgatatggttgccgtgttccgtgtcaacaatgagggcaaagcaacgatggtcgcggtcgatccttatacggcaaaagtggtcagtaccatgccgcgcaatcagggttggtattacacgatggatgaaatccacagcgatatgatgctcggtgcggcaggcgattatcttttggaaacggcagcttcactgaccattattatggttgtcagcggcttgtacctttggtgggtgaaacggcgcggcatcaaggcgatgctgctgccgtcaaaaggcagggcgcgttcttggtggcggaatctgcacggcacgtttggaacttgggtgtcgttgattttgctgttgttctgcctgtcgggtattgcttgggcgggtatttggggcggcaagttcgtacaggcttggagtcagttccctgccggtaaatggggtgtcgaaccgaaccccgtttcagtcgtgccgacccacggcgaggtattgaatgacggcaaggttaaggaagtgccgtgggttttggagcttacgcctatgcctgtttcagggacgactgtgggcaaagacggcattaaccctgacgagccgatgacattggaaaccgtcgaccgctttgcgcgggaaatcggtttcaaagggcgttatcagttgaatttgcccaaaggcgaggacggcgtatggactttgtcgcaggattctatgagttacgacatgatcagcccgtttgccgaccgcacggtacatatcgaccagtacagcggcaaaatccttgccgacatccgttttgacgattacaacccgttcggcaaatttatggcggcaagcattgcgctgcatatggggactctgggctggtggagcgtgttggcgaacgtcttgttctgccttgccgtcatttttatcggtatcagcggctgcgtgatgtggtggaaacgccgtccgaccggagcggtgggcatcgttccgccggcgcagaaagtcaagctgccggtttggtggatgatggcattgccgctattggcaatcgcactgctcttcccgacctcactgcttgccattgccgtgatttggctgttggatacgctgctgttgtcgcggattcctgttttgaggagatggtttaaatgaccaaatgccgtctgaaaggttcagacggcattttgtttgaaggcggacgggggaaaggctatataatcccgaatacttgaccacagcttctgtttgaaatcatgttttatctgtatcaatccaaccgtcttgaaacgctggcggcattgtttgcccgcattcaaaaagtcaaaccgctgaaatcggctttacagcccgaacagattattgtgcagagtcaggggatgcgccgctacctcaatacctgcctcgcccgcgatttgggcgtggcggcgaatttgtcgttcagcctgcccgccggcctgacgtggaagctgatgaaaaaactgattcccggtattccggaactcagcccgtttgcgcccgaagtcatgcgctggcggctgctggatttgttccgcagcgaggcatttcggaatacggcagaatttgaagatgtgaggaatgtgctgcaagactatctgggcagcggcgaatcggcagattaccagcttgcgggacagcttgcggacatattcgaccaatacctcgtgtaccgtcctcagtggatagacgcttggcagcagggcaggcggctcggtttgggcgacgacgaaatctggcagtccaaactgtggcgttacctcgacgacggcaggcagagcgcgccgcaccgtgtcgcgttgtgggaaaagctgttggaatctttgagcagtgataagctgcccgagcgttatttcgtgttcggcatttccacgatggcgccgatgtatttgcaacttttgcacaagctgtccgaacattgcgacgtgttcgtgttcgcactcaatccgagcgggatgtactggggcaacgtcatcgaagcggcgcaaatcctcaaaggtggcggcgatcccgatttaactcaggcagggcatccgctgctcgcctcattgggcaagcaggggcgggactttttcgactttttgaacgaaatggaaatagaaggcgaaacgccggtatttgaggaaggcgggcgcgatacgcttttacacgccctgcaaaccgatattcaaaacctgaaaatgccgtctgaaatggcgggaagcgtcaacacgggcgacggctcgatacgcatcgtctccgcacacagccctttgcgcgaattgcagatactcaaagacaagctgttgaaaattctgcatgaacatcccgattggcagccgcacgatatcgccgtattaaccccgaatatcgaatcctatacgccttttatcgaagccgtgttcggacaggcgcagcccggtgcgcaggcattgccgtattccgtgtcagacgtgaaaatcagccgccgccaaccgctgtttcatgctttgtcatgcctgttcgacttgttggaaagccgatttgaagtcgataaagtgcttgtgcttttagaaaccgcgcccgtgttgcgccgtttcggactgactgaggacgatttaccgcttttgcacgacatggttgccgatttgaacgtccactggggtttggacggagaaatgcgcggcggcacggatcagctgttcacctggaagcaggcggtagaacgcatgatattgggctggatgctgcccaaaggcggcaatccgatgtggcaggatgtcagcgcgtggtatgccgacgtgaatcaaaccgccatgttcggacgttttgccgccttcctcgaaaccctgacggatattgtacggatatggcggcagcccgcaacggtcggcgaatgggtggcgcgttgccgggatttgcttgaaacattgttccaagctgaagccgatgaccaaaagtcagtccaaaaccttgaaaacgaatgggtcaaatggcaggcggaaaccgaattggcgcaattttccggacagttgccgccgcacaccgtcatccgccatatccgacgctttctcgacagcgaaagcgaggcaggctttttacgcggcggcatcaccttttgcagtatggtgccgatgcggagcctgccgttcaaagtcatctgcctgttgggtttgaacgacggagattttccccgtaataccaaagccgccgtattcgacctgattgccaaacatcccgccaaaggagaccgcgcccgccgcgatgacgaccgctacctgttcctcgaagccctcatcagcgcgcgtgaaatcctctacctgtcctacatcgggcgcgacatccgcaaagacgaagagcttgccccgtcttccctgttgggcgaactcatcgataccgttgccgctatggcgggcatcggtagccgccaacttgcacaaaacctgatagaacagcatccgctgcaagccttctcgcgccgatattttcaagaaggcggacgttcagacggcatattcggcacgcgtaccgactacgccgccgcgctcggacaaacgcccgaaccgccgcaaccctttttcgatcaacccgtagaaaacgccgaacctgttgccgaaatcggacaggacgaatttatccgtttctggcgcaaccctgtcaaagtatggcttcagcagcagcttgcgtggagcgaaccccatatcggcgaagcctgggagcctgccgaacccttcgagccgcaacacgccgatcaaatcgccgaaatctacatcgaagcacggtgcgaaggacgggattttgcccaaaccgccgcccgcatcggggcggaaagcctcctgccgtcgggagagttgggcagactttggcagcaggacttccaaactgctgccaaacaaatcgacacggcggttttaaacagccccaaactgccaccgctttcatatgccataccgtcggacgggcaaatcctgaaaggcagcttgggcaatctgtaccgctgcggacaagtgttttacgcctacggcaaacccaacgcgccgcaacgtatcgcttttctgctggaacacctgatattttgcgccgttatgccgtctgaagccgaaatgcggcaaacctttatcgtccaatccggagaaaccgaaatattggcggaaatcgcgcaagacagggcattgcagctattgtcggaatggatggcgtttttcaatatcgggcaaaaccgcccgctgccgttttttgccaaaacctcgcttgccaccgccgaagcgtttgcccaaaaacaagattgggaagccgccctgaaaaaagcccaaaccgcctaccacggcagcaaagtcagcaaagggcagaaagactataccgaagtcgccctcgtgttcggcaacgcaagccaaaacccgctcgaacagcccctgtttgaaaacctcgtccgtctgcttgccgacacgcttgccgcagcggaaaaaaaggaagaggccggagaagcctgacgggatagaaaggcaaatgccgtctgaaagcgtttaagcatttcagacggcattttgtttatcgtgtttaaggtgcgggatagaatgtgggcgcgccgggaccgacgggcaggcccaaaacaaatacccaaatgcagaataaggcaatccacgcaatcaagaagaaagcggaatacggcaacatcatagaaatcagcgtacccacgcccgcatcttttttgtatttgatcaccgtcgccataatcagcccgaaataactcatcatcggcgtaataatattggtaacggaatcaccgatgcggtaagcggcttgaatgacttcgggcgcgtagccggccaacatcagcatagggacgaaaatcggcgcagttaccgcccattgcgcggaggcggagcctatcatcagattgataaaagcacaaattaaaataaaaccgataaacaacacgctgccgcccaagccgacttcttttaagaacgtcgcccctttaacggcaatatattgcccaatattcgtccaattaaaaaatgcgacaaactgtgcggcaaaaaagatgatgaccaaataaagccccagagtactcatcgattcggccatcgcattaacgacttcctgttcgccgcgcaaacttcgggttacccggccataaacaatgcccggcagtgcaaacaacaagaaaataaaaacaacaatcgattttaaaaacggcgaaccggaaaccaatcctgtttcaggatgacgcaaaataccgtcggcagggacgatgctccaagccaatagggcggataaggcaacaaacaccacgccagcccaaattaatcctttatattccaaaggcgtgatttcattggaatgccgaatgtctttttcttcttgtgacaaatctgattgataagggcccaattgcggttcgacgattttttcagtaacaaaataaccaatcaaagcaatcacaaacgtactggctaccataaaaaaccagttggcttcagggcctacgacgtagtcgggatggatgatttgcgccgcctgttgggtgatgcctgccaagagcggatcgattgtgcctaagaacagattggccgaataaccgcccgaaacgccggcgaaagccgcagccagaccggcaagcggatggcggccgagggaatgaaagatgatggcggacaaagggattaggacgacatagcccaattcagaagcggtattagataaaatccctgtaaaaacaaccataaaagtagtgagtttgcgtggcgattttgtgagcaataagcgcattaatgcggaaatcaagcccgatttttccgcaatccccacgcccaataaagaaaccaacaccgttcccaacggcgcgaaaccggtgaaatttttaacggtatgcgtcaggattttgataaaaccgtcggcattgagcaggctgacaatgtaaatcaaaccgtcatcggcacgtcctttcgcaccaacagggcgcggatcggggacggatagtccgaaatacgcaccgacggcagaggcaatcagcaataacacaatgaaaataataaaaagcgtaaccggatgcggcaacatattgcccagccattcgactgtgcgtaaaaatcgtccgtcccgttgcgtatcggtttgactcatctgcttctccttaaaaaaatatattgagtgcattaaatttttgaatgtaacatgaagtgttttgtaagcaaactaaaataatcgcatatgtatataaccgcaatagattaaaacagaaaatgcccacatcgttattctcataaaggcggtaatccgaaaacttgacgttaaagccttatcaggaatgactggaactcaaaaaacggtttcccgttttcgcggaaatggcgggattttcagtttttatttgcaaaaatgctggagaaaaatgcagtttacattttgaatggtattgttattaattgtaaataaatattggaaggtaaatgatatgaaaaatgaaattcaaaaaaatatggacaaatataatccctggcatgaagatgattttgagtcgtatgaagacattgccagagatgtatcgctgacgacagataaaacgttcattgaacattatttgttagaagtttattcagaagaaaacggacattttgaccaagagaatgtccatgcaatgatagaagaaattaaaaatgcaatttagtgaatatgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaataagattgagcataaaattttagtaacctatgttattgcaaaggtctcaatatgtatttttagaagaaggctttgtgtcattttgatgccgtctgaaagggtttgttcgtttcagacggcattgctaccaaggcttgattatttccggcgcaggtcgggatggttttccaagttgtccatcattatcccgatgatgcgcggggcggttttgcccaaatcgaaacgttcgcaggaagagaaccaccgccaaatcagcccgtccaaggttgatttgatgaagataactgccgtttccttgtccaaatcgtcagccaaatcctgattttccaccgcttcggtcaaaacggcggtaattttctcgcgccagattgcctgatgcttgcgggcaatggcgataacggcggcgttttgctccgtgtgttcgcattttaaaaacaggatgttgtggaatttgtagtagatgtcgttgctttgcagccgctcgaaaaagtgcagcagcgtgtggcggaataccgcccaagaccctccttcggcatcttcggcatcttgcgcgatgcagttttcgatgtcgtcgcagatacgttggaacagcgcgtcgaacaagtcttccttatttttgaaatgccaatagagcgcgccgcgcgttacgccggcggcttgggcgatttcgttgagcgaggtgcgcgcaatccctttgcggtaaaaggtttccaaggcggcaagcatcaggtgttctttggtttttaaggcttcggttttggtttttctcataatggcggtttcgtttcgggtcggtttgatgagggcggattataaaaaagactttgtaaccatgcaatcgtgtatgtataatgaaacccatgaaattgagactacatctcaactttgaaaacccatgaaacctgcttcgcaacccgtttgaacatcgggttggcgaagcaggcggtttttatatcctgaaatatagtggattaacaaaaatcaggacaaggcggcgagccgcagacagtacaaatagtacggaaccgattcacttggtgcttcagcaccttagagaatcgttctctttgagctaaggcgaggcaacgccgtactggtttttgttaatccactataagaatgcctgttgattggcaaaaccctttacatcaaaccagacagataggataaataatggctttttatgcttttaaggcgatgcgtgcggccgcgttggctgccgccgttgcattggtactgtcgtcttgcggtaaaggcggagacgcggcgcagggcgggcagcctgctggtcgggaagcccctgcgcccgtcgtcggtgtcgtaaccgtccatccgcaaaccgtcgcattgaccgtcgagttgccggggcgtttggaatcgctgcgtaccgccgatgtccgcgcccaagtcggcggcatcatccaaaaacgcctgttccaagaaggcagttatgtccgtgccggacagccgctgtatcagatcgacagttccacttatgaagcaggtctggaaagcgcgcgcgcgcaactggcaacggctcaggcaacgcttgccaaagcggatgcggatttggcgcgatacaagcctttggttgccgccgaagccgtcagccggcaggaatacgatgctgcggtaacggcgaaacgttctgccgaggcaggcgttaaagcggcgcaggcggcaatcaaatccgccggcatcagcctgaaccgttcgcgcattaccgcgccgatttccggctttatcggtcagtccaaagtttccgaaggtacgttgctgaacgctggcgatgcgaccgtactggcgaccatccgccaaaccaatccgatgtatgtgaacgttacccagtctgcatccgaagtgatgaaattgcgccgtcagatagccgaaggcaaactgctggcggcggatggtgtgattgcggtcggcatcaaatttgacgacggcacagtttaccctgaaaaaggccgcctgctgtttgccgatccggccgtcaacgaatcgaccggtcagattaccctgcgcgccgccgtaccgaacgatcagaatatcttgatgcccggtctgtatgtgcgcgtgctgatggaccaagtggcggtggataacgcatttgttgtgccgcagcaggcggtaacgcgcggtgcgaaagataccgtgatgattgtgaatgcccaaggcggtatggaaccccgcgaggtaacggttgcgcaacagcagggtacgaattggattgttacgtcgggtctgaaggacggggacaaggtggttgtggaaggcatcagtatcgccggtataacgggtgcgaaaaaggtaacgcccaaagaatgggcgtcgtctgaaaaccaagccgccgcgcctcaatccggcgttcagacggcatctgaagccaaacctgcttctgaagcgaaataaggaaggcatcgatggctaaattttttatcgaccgccccatttttgcgtgggttatttcgattttcattattgcggcgggtattttcggcatcaaaagcctgccggtttcgcaatatccgtccgtcgccgccccgaccatcaccctgagggccacttatccgggcgcgtccgcgcaggtaatggaagacagcgtgctttccgtgatcgagcggaatatgaacggcgtggaaggtttggattatatgtccacttccgccgattcgagcggcagcggcagcgtgagcctgacctttacgcccgataccgacgagaatctggcgcaggtggaagtgcagaacaagctttccgaagtattgagcacgctgccggcaactgtccagcaatacggcgtaaccgtatccaaggcgcgttccaatttcctgatgattgtgatgctttcgtcggatgtgcagtcaaccgaagagatgaacgactacgcgcagcgtaatatcgttcccgagttgcagcgtatcgaaggcgtggggcaggtacgcctgttcggcgcgcaacgcgcgatgcggatttgggttgatcctaagaaactgcaaaactacaatttgtcgtttgccgatgttggcagcgcgctgtccgcccagaacgtccagatttcagcgggttctatcggttcgcttcccgccgttcgcggacagacggttacggctaccgtaacggcgcaagggcagttgggtacggcagaagaattcggcaacgtcatcctccgcgccaataccgacggttctaatgtttacctgaaggatgtggcaagggtcggactgggtatggaagactattcttcctcaacccgtctgaacggtgtaaataccaccggtatggcggtgatgctgtccaacagcggcaatgcgatggcgacggcaaaggcggttaaagaacgcatggcgacgttggaaaaatactttcctcagggtatgagctggaaaaccccttacgatacttccaaattcgtcgaaatttcgattgaaaaagtgattcacactttaatcgaagcgatggtgctggtgtttgtcgtaatgtatctcttcctgcaaaacatccgttatacgctgattccgaccatcgtcgtaccgatttcgctgttgggcggtttcgccttcatctcttatatgggcatgtcgattaacgtactgaccatgtttgcgatggttttggtcatcggcatcgtggtcgatgacgcgattgtggtggttgaaaacgtcgagcgcattatggcgggtgaaggcttgccgcccaaagaagcgaccaaaaaagcgatgggtcagatttcgggcgcggtcatcggtattaccgccgttctgatttccgtgttcgtaccgttggcgatgttcagcggggcgacgggcaatatttacaaacagtttgccctgacgatggcgtcatcaatcgcattctccgccttccttgcgctgacccttacccctgctttgtgtgccacaatgttgaagacaatcccgaaagggcatcacgaagagaaaaaaggtttcttcggctggtttaacaagaaattcaacagttggacgcacggttacgaaggccgggttgccaaagtgctgcgtaagactttccgcatgatggttgtctatatcggcttggcggttgtgggcgtgttcctgtttatgcgcctgccgacttcattcctgccgaccgaagaccaaggcttcgtcatggtcagcgtgcaactgcctgcaggagcgacccaagagcgcaccaatgcgactttggcgcaagttacccaactggcgaaaagcattcctgaaatagaaaacatcattaccgtttccggcttcagcttttcgggcagcggtcagaatatggcgatgggttttgccatattgaaagattggaacgagcgtaccgcgcccggcagcgatgccgttgcgattgccggcaagctgacgggtatgatgatggggacgcttaaagacggttttggcatcgccgtcgtcccgcctccgattctggagttgggcaacggttcgggtctgagcatcaacctgcaagaccgcaacaataccggccataccgcattgctggcgaagcgcaacgagttgattcagaaaatgcgtgccagcggtttgtttgaccccagcaccgtccgtgctggcggtttggaagactcgccgcagttgaaaatcgacatcaaccgtgccgcggcggcggcgcaaggcatttcgtttgccgacatccgcaccgcattggcaagcgcgctgagttcgtcttatgtcagcgacttcccgaaccaaggccgtctgcaacgcgtgatggtgcaggccgacgaggatgcccgtatgcagcctgccgatattttgaacctgaccgtgccgaacaaatccggcgtcgccgtaccgctttccaccattgctactgtttcttgggaaaacggtacggaacagagcgtacgcttcaacggttatccttcgatgaagctgtccgcttcgcctgcaaccggcgtttccaccgggcaggctatggcggcggttcaaaaaatggttgacgaattgggcggcggttacagcctggagtggggcggacagtcgcgcgaagaggcaaaaggcggctcgcaaaccctgattttgtacggtttggcggttgcagccgtatttttggtacttgccgcgctttatgaaagctggtcgattccgctggcggtcatccttgtgattccgttgggtttgatcggtgcggctgcgggcgtaaccgggcgcaacctgtttgaaggactgttgggcagcgttccctcgttcgccaacgacatctactttcaagtcggtttcgttaccgtgatgggtttgagtgcgaaaaatgcgattttgattatcgaatttgccaaagaccttcaagcgcaagggaaaagcgcggttgaagccgctttggaagccgcccgcctgcgtttccgtccgattatcatgacctcgttcgcctttattttgggcgtggttcccctgtatattgccggcggtgcaagttctgccagccagcgcgccatcggtacaaccgtattctgggggatgctcatcggcacgctcttgtccgtgttccttgttccgcttttctatgtggtggtgcgcaaattcttcaaagaaaccgcgcacgaacacgaaatggcagtaaaacacgccgccgaagcgggcatcaccggttcggacgacagccaacattaagcaaccatgccgtctgaacgcccacgggttttcagacggcatcaggacttttttatggatactacattgaaaaccaccttgacttctgttgcagcagcctttgcattgtctgcctgcaccatgattccccaatacgagcagcccaaagtcgaagttgccgaaacgttcaaaaacgataccgccgacagcggcatccgcgccgtcgatttaggttggcatgactattttgccgacccgcgcctgcaaaagctgatcgacatcgcactcgagcgcaataccagtttgcgtaccgccgtattgaacagcgaaatctaccgcaaacaatacatgattgagcgcaacaacctcctgcccacgcttgccgccaatgcgaacgactcgcgccaaggcagcttgagcggcggcaatgtaagcagcagctacaaagtcggactgggtgcggcatcttacgaactcgatctgttcgggcgtgtacgcagcagcagcgaggcggcactgcaaggctatttcgccagcaccgccaaccgcgatgcggcacatttgagcctgattgccaccgttgccaaagcctatttcaacgaacgttacgccgaagaagcgatgtctttggcgcaacgtgttttgaaaacgcgcgaggaaacctacaagctgtccgaattacgttacaaggcaggcgtgatttccgccgtcgccctacgtcagcaggaagccctgatcgaatctgccaaagccgattatgcccatgccgcgcgcagccgcgaacaggcgcgcaatgccttggcaaccttgattaaccaaccgatacccgaagacctgcctgccggtttgccgctggacaagcagttttttgttgaaaaactgccggccggtttgagttccgaagtattgctcgaccgtcccgatatccgtgctgccgaacacgcgctcaaacaggcaaacgccaatatcggtgcggcacgcgccgcctttttcccatccatccgcctgaccggaaccgtcggtacgggttctgccgaattgggtgggttgttcaaaagcggcacgggcgtttggtcgttcgcgccgtctattaccctgccgatttttacctggggtacgaacaaggcgaaccttgatgtagccaagctgcgccaacaggtacaaatcgttgcctatgaatccgccgtccaatccgcatttcaagacgtggcaaacgcattggcggcgcgcgagcagctggataaagcctatgacgctttaagcaaacaaagccgcgcctctaaagaagcgttgcgcttggtcggcctgcgttacaagcacggcgtatccggcgcgctcgacttgctcgatgcggaacgcagcagctatgcggcggagggtgcggctttgtcggcacaactgacccgcgccgaaaaccttgccgatttgtacaaggcactcggcggcggattgaaacgggatacccaaaccgacaaataaccggtcgggcaataaaatgccggcggattcgcatttgaagtgcaactttccctaacagaaaaaggccagtatgcggtagcatacggcctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacacccttatccgccgcaaactcagtcccgaacaagtatgcgcctacctgtgcaaacaccaccggatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccatcaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaaggccgtctgaaacgataaggtttcagacggcatttctttctttatagtggattaacaaaaaccagtacagcgttggctcgccttagctcaaagagaacgattctctaaggtgctgaagcaccaagtgaatcggttccgtactatttgtactgtctgcggcttcgtcgccttgtcctgatttttgttaatccactatatgtttgacggttgcggtcaggctgcgcggcgtgccgtaaacgtgaatgtcgggcatagggcggtagcgtttgttgaacacgttttcaaagtccaaaccgatgcgggtggatttgccgattttgtaatgcgcggtcaaatacagtgtggcgtaggggcgttgggtcaatgcggctgcggcggcagggaagaaaccgccatacccgtcggcatcccgaagccgaatacggcaacggcaagcgcaatcagcagcgtataaagccccgcctgatagcctttcagcttcaggacggtcagcgcggcaaagaaaaagacgatgggtaagagtgcggcggcggcagtcagatacaggctgccgccgattgccgtgtagttttgaacccaagtttccataattgaacatctccgaaaatatttttctaatcgtcggcaatagtggtcaaaccaattaaagcaacgttgcattactttacgaaactttaatatttaggtcaatatatttttgggcggttcggcagatttgaatcggagcttttgtttaaatcctgtcaaaacaaatatttgcatgaacaaaaattgtagtttggtgtagttttttcttgtgtttcgggggcggtgcgaggtaaatrccgttgacggcgggaacggcgtgtcattagaatccgccctgattggtcagtccaatttgatgtttgatgtatagtggatgaacaaaaaccagtacggcgttgcctcgccttagctcaaagagaacgattctctaaggtgctgaagcttcaagtgaatcg

SEQ ID NO: 37802 - DNA, 32051 bp, Neisseria meningitidis
atcggcgcggcaggagaaattgtcggcgcaggcgatgccgtgcagggcataagcgaaggctcaaacattgctgtcatgcacggcttgggtctgctttccaccgaaaacaagatggcgcgcatcaacgatttggcagatatggcgcaactcaaagactatgccgcagcagccatccgcgattgggcagtccaaaaccccaatgccgcacaaggcatagaagccgtcagcaatatctttatggcagccatccccatcaaagggattggagctgttcggggaaaatacggcttgggcggcatcacggcacatcctatcaagcggtcgcagatgggcgcgatcgcattgccgaaagggaaatccgccgtcagcgacaattttgccgatgcggcatacgccaaatacccgtccccttaccattcccgaaatatccgttcaaacttggagcagcgttacggcaaagaaaacatcacctcctcaaccgtgccgccgtcaaacggcaaaaatgtcaaactggcagaccaacgccacccgaagacaggcgtaccgtttgacggtaaagggtttccgaattttgagaagcacgtgaaatatgatacgaagctcgatattcaagaattatcggggggcggtatacctaaggctaagcctgtgtttgatgcgaaaccgagatgggaggttgataggaagcttaataaattgacaactcgtgagcaggtggagaaaaatgttcaggaaataaggaacggtaatataaacagtaactttagccaacatgctcaactagagagggaaattaataaactaaaatctgccgatgaaattaattttgcagatggaatgggaaaatttaccgatagcatgaatgacaaggcttttagtaggcttgtgaaatcagttaaagagaatggcttcacaaatccagttgtggagtacgttgaaataaatggaaaagcatatatcgtaagaggaaataatagggtttttgctgcagaataccttggcaggatacatgaattaaaatttaaaaaagttgactttcctgttcctaatactagttggaaaaatcctactgatgtcttgaatgaatcaggtaatgttaagagacctcgttataggagtaaataaaaatggcaatttggaattatcggtactaccttatcccatcagctgctatcagaaataaatttaatgcaaataaagatatcatacttgatgagtatcgatctaatggttttcagaattttaatgagaataaaagttttgaaaattactttatcgataatgatgttatattattatcaataataaatgaagcaaaaaaacagcttaaattgaaagaatcttgggataaagacgcaatcatgttttgtgataattttggtaatagtcttaccgtttggccagatgatatagagtgcgaacttgatttaagatttgattatactaaatttattcagaaaaccattgattgggcaataaaatataattgtctacttgtaatagaaaaaacaggaaatgtagtttcccctaatataaataatctgatgtatgaaataaaagcatatttggaaagcaagccgtggcccatatgaaacctaaactcaacaagtaggatgtgtgcggaacgcacgtatgcggttctcaaggtttgagctaagaggccgtctgaaaacagaaaaactgtttcagacgacctttcttttaaccagttgccacagcaaccggacaaaagcagcctacctccacatccatataggcaatacaggggagatattttgtaaattctacgaatattttacctgctaaacagggtaggatatggtatgaagcgaacattggcttaataaacactatgtcaagatcgaatcaggctggtactagattgttgtattccaattatggattgctatatataacaactgatcattatatctctgcaacacggtttgtagcttggaaataggagtataacttatgcaattagagattatcggtagtaaaatttatacggaacaagattttcataatcaaatttcaaaaatattttctatacaagattattatgggaacaatcttgatgctttatgggatttattaagcacaaatgtagaacgaccgattactttggtatggaaagatgctatgttctcaaaaaatcaattagaaaatatatttattgaaatcgtaaatgttctagaaagagttaagaaacaagatgaggattatggattcgaagaaaaatttaattatattttagagtaagtaaaccctaattacattacgtacacaggcttaaaactccccagagccaattaagcaagccgtaacccatataaaacttaaactcaacaagtagcatgtgtgcggaacgtacgcatgcggttcttaaagtttgagctaagaggccgtctaaaaacagaaaaaccgtttcagacggtctttgtttaacgccaccgatccagcgggttacaaagcgcagtcaatgccgctgcgccttatgcctccgaagcaataggcagaacatttggacacggtgaaaacaaaaacgaaaccgcccaagccgtcggacatttccttttaggagcagctattgcccgcgtcaacggtggtaattttgctgccggcggctcggcagcagttgcagctgaaaaggcggcggaacatcttgcccaacagtataacgacggtaaaaccgcaatcgatccgcaaacaggcgagttcaatgccaacctgctgccggaacatatcaaagaggaaatcaaatcaaagagcggggtgattgcatcgctgacgggcgcggccgtgggcggcacgccggtagatgcgcaaaccggaggtgcggtcggacagaatgcggtggaaaacaacctctatctgacatcggaagccttaaagaaggacaagcagacagctcgtaaaatttattccgtcataaaagagcaagtcaagcatgaatgcagttccacaggaagaattaccgaatgtcgtcaaaatataggacgcattatcgaatttacccaagacaaacgctttgacagtaggtttaaggacttaaaaaaagaatccttatattacctaaataaacatcctgatttagtagcctcttatttgaaggctgaatacgaaaagctggatagggaagacaaaagtatcctgcaccgctacatctcacccggggctgaaatcgtttcgggcagtttgggggttgttctttcaggagtagccggaggcggatcttgtgccgagactttcggcttaggctgtgccgccgctttggttggtgtaacgtcttcctacgatcatgtcattactgggacgaaaaacttcggaaaaaaagccagcgagcaacgaccgacgattgcggttcaggccttgaagcagttggggctgtcggagcaggctgcggaatatgttcagttctctatagatttgttcagtgtgggtaaatcggggggcggtatacctaaggctaagcctgtgtttgatgcgaaaccgagatgggaggttgataggaagcttaataaattgacaactcgtgagcaggtggagaaaaatgttcaggaaacgagaagaaggagtcagagtagtcagtttaaagcccatgcgcaacgagaatgggaaaataaaacagggttagattttaatcattttataggtggtgatatcaataagaaaggcacagtaacaggagggcatagtctaacccgtggtgatgtacgggtgatacaacaaacctcggcacctgataaacatggggtttatcaagcgacagtggaaattaaaaagcctgatggaagttgggaggtgaaaacgaaaaaaggtgggaaagtgatgaccaagcacaccatgttcccaaaagattgggatgaggctagaattagggctgaagttacttcggcttgggaaagtagaataatgcttaaggataataaatggcagggtacaagtaaatcgggtattaaaatagaaggatttaccgaacctaatagaacagcatatcccatttatgaatagtaatatttatgaaaaattaggagattaatgatgaaaagaattaagtgcttttgtgataaatttccatcaggagatacatttagaatgtgtatcattctggatgactatgataatagggttgattattatgtaggaatatatgattacattacgtctaccttaatgagcgatatttactatcgatccacgattgatgagcatttcaagattatagaattaatagaaaataatccaaatgaaatttatgatgatggcggtggtcaacaattttgcctagaatttcatcatgataaggtcattttttaccacaatgaatttgatgaagaagatggttatccagtattaagctgttcgctgcatacttttaaaactgctttaattgcttggaatgcttttttgcaattgcctaaaagtattcattcggtggtggagactgtgattgaggaataagcataattagcttaatgaatagaatcagcgatatagattggactgcaaatccacgcttatacgctgtgccatgattaagatgttagaacttgtattgaatacaagttctcataaacgaatggcagtaagcatttgatttagataaaatccttgaattagaataatcaggtctaagagctcgacaggacaaatgaggctggcaaccaaggatttggcggaagccattaggaaaggacaggttcgcaaatcaagctttaacacagaacaattaagggcaattgaaaaaggagaatctaaaataccggattacacttggcatcatcatcaagatacaggaaggatgcaattgattcgtgaaggcttgcatcatgataccggccatattggttgggaagcaatgaacaaaggaaggtaactatgtggaaaatcataaaagaggatagtgatgatttagaatttgcaattaaatgcttattctctcagtctattgatttaaatgaattcaagttatggattgaacaagtaatacgcgatatgcccatcgaggacatccctttttatatttttgatttggcggattttgatgggggaattgccgatattgacaatattgtaggttttgtttcaagttgcagactatcaaaatcgaaaaaaaatgccttgaccggcattgccttcttaagggggatagatgtctatgatccgcctatttcaaaagaaaaagcattaaaagccttagagaaacatcctgaaatttatcagaaatttcagcatttctttccgtttgtagaactgcccccgctttaaacagtcaaaatgccgtctgaaacgatattcggctttcagacggtatttttgatataaagcgggtaactaaaagagcgtttgacggcaaaggaagataattatgtggaaaatcataaaagaggatagtgatgatttaggatttgcaattaaatgcttattctctcagtctattgatttaaatgaattcaagttatggattgaacaagtaatacgcgatatgcccatcgaggacatccctttttatatttttgatttggcggattttgatgggggaattgccgatattgacaatattgtaggttttgtttcaagttgcagactatcaaaatcgaaaaaaaatgccttgaccggcattgccttcttaagggggatagatgtctatgatccgcctatttcaaaagaaaaagcattaaaagccttagagaaacatcctgaaatttatcagaaatttcagcatttctttccgtttgtagaactgcccccgctttaaacagtcaaaatgccgtctgaaacgatattcggctttcagacggtatttttgatataaagcgggtaactaaaagagcgtttgacggcaaaggaagataattatgtggaaaatcataaaagaggatagtgatgatttaggatttgcaattaaatgcttattctctcagtctattgatttaaatgaattcaagttatggattgaacaagtaatacgcgatatgcccatcgaggacatccctttttatatttttgatttggcggattttgatgggggaattgccgatattgacaatattgtaggttttgtttcaagttgcagactatcaaaatcgaaaaaaaatgccttgaccggcattgccttcttaagggggatagatgtctatgatccgcctatttcaaaagaaaaagcattaaaagccttagagaaacatcctgaaatttatcagaaatttcagcatttctttccgtttgtagaactgcccccgctttaaacagtcaaaatgccgtctgaaagccatttccgccgctcagacggcattttcgccccttttgtttacaaacccttaaaatccctttacactcaaaatccgttcaacatcaaacaaaccccgctatgaaaaccctgctcctcctcatccccctcgtcctcacagcctgcggcacactgaccggcatacccgcccacggcggcggcaaacgctttgccgtcgaacaagaactcgtcgccgcatcgtcccgcgccgccgtcaaagaaatggatttgtccgccctaaaaggacgcaaagccgccctttacgtctccgttatgggcgaccaaggttcgggcaacataagcggcggacgctactctatcgacgcactgatacgcggcggctaccacaacaaccccgaaagtgccacccaatacagctaccccgcctacgacactaccgccaccaccaaatccgacgcgctctccagcgtaaccacttccacatcgcttttgaacgcccccgccgccgccctgacgaaaaacagcggacgcaaaggcgaacgctccgccggactgtccgtcaacggcacgggcgactaccgcaacgaaaccctgctcgccaacccccgcgacgtttccttcctgaccaacctcatccaaaccgtcttctacctgcgcggcatcgaagtcgtaccgcccgaatacgccgacaccgacgtattcgtaaccgtcgacgtattcggcaccgtccgcagccgtaccgaactgcacctctacaacgccgaaacccttaaagcccaaaccaagctcgaatatttcgccgttgaccgcgacagccggaaactgctgattacccctaaaaccgccgcctacgaatcccaataccaagaacaatacgccctttggaccggcccttacaaagtcagcaaaaccgtcaaagcctcagaccgcctgatggtcgatttctccgacattaccccctacggcgacacaaccgcccaaaaccgtcccgacttcaaacaaaacaacggtaaaaaacccgatgtcggcaacgaagtcatccgccgccgcaaaggaggataaaccgtgaaaccgctgcgcagactgacaaacctccttgccgcctgcgccgtagcggcggccgcactcatacagcccgccctcgcggcggacttggcgcaagacccgttcattaccgataacgcccaacggcagcactacgaacccggcggcaaataccacctcttcggcgacccgcgcggcagcgtttccgaccgcaccggcaaaatcaacgtcatccaagactatacccaccagatgggcaacctgctcatccaacaggcaaacatcaacggcacaatcggctaccacacccgcttttccggacacggacacgaagaacacgcccccttcgacaaccacgccgccgacagcgcgagcgaagaaaaaggcaacgttgacgaaggctttaccgtataccggctcaactgggaaggacacgaacatcatcccgccgatgcctacgacggcccgaagggcggcaattaccccaaacctacgggcgcacgagacgaatacacctatcacgtcaacggcacagcccgcagtatcaaactcaatccgaccgacacccgcagcatccggcaacgcatatccgacaattacagcaacctcggcagcaatttctccgaccgcgccgatgaagccaacagaaaaatgttcgagcacaatgccaagctcgaccgctggggcaacagcatggagtttatcaacggcgtcgccgccggcgcgctcaacccctttatcagcgcgggcgaagccgttgaccagtggatgcaggaaaaccccaatgccgccgaaaccgtcgaagccctggtcaacgtcctgccgtttgccaaagtcaaaaacctgacaaaggcggcaaaaccggggaaggctgcggttagtggggatttctcagactcctacaagcataacactgcttcaagattatctcagtctgtagatggagaaatgtttcaaacccgcaatgttgattttaaagcaaaatctattgggactaaaattcatgatggagctcaagggaaacatatttcaggacatagaaactacattgaaggtaagagtactttaaatcaaaacattaatcctcaagaattgttgaacggaatacattcaggtgcttatccagttatttctaaaggagcaagaggaaatcctgttgttgattttgggtatcctataggcagcgatgggaaatcaggattaagtaccaattttggtacgattcattcaggtaaaaatggagttcacattgttccggctaaccctaaaaccattaaaaaggtgcaatagttatgaatatattaccaagctggctgcgagtcggtatgaatatagcaatgctgggcatgatacactcagatatcaggttaattaccgtagattacgaggaaggaagaaggtttttaaaaatcaaaaattatttatcaagagaagccatcacagaagaccatgaagatatggaatatttgattacagagttatggtctatgtgtggagaatattttgatgaagctgactttgaatgtatttattctaatcattcttctatggagttaaaccaaataaatggtgcagtattcaggagaaaggaattaatttcgcaagcgtaggttaaaaaaaccaacaatcacaatgtcttctgaaaccgtgtttaattttcagacggcatttccttcatttgaaataggatattgagaactgagttcttcaaaaatcctacacctgctccttccacggcagcaccttggtcaaaacggcagacggctacaaagccattgcccgtatccgaaccggcgaccgcgtcttcgccaaggacgaggcaagcggaaaaacgggatacaaacccgttaccgcccgatacggcaatccgtatcaagaaaccgtttacattgaaatttcagacggcatcggcaacaaccaaaccctgatttccaataaaatccacccgttttacagtcaaggaaaatggatacaggcaggtcgtctgaaaaaaggcgacaccctgctttccgaaagcggcgcaaaacagacggttcaaaacattaccttcaaacagcagccgctcaaagcctacaatctgaccgtcgccgattggcatacctacttcgtcaagggcagtcaggcggaaacggaaggggtttgggttcataatgattgtccgtatgataaaggcaaccaacgatataaagacgcttcttatcatggcaaaaatgataattctgtgaaaagtagagcaccaacaaacggacaagcagctcttgataattccgttcaagttaaatcaacttctcctcgaagagttggggttgataaagccaataatgaaatcgttgtattaaacaaaactcaaacttttaataacggttctgcggaatatcacgggcatgtcagaagttggcaagatttgcataccgatcagaaaaatgctttaaaaaaagcaggattggattagttaattcaaaaggaaaaattaaaaaatgactgataaaagtaaaacagaaaagttgatttcttctgatgataaacaaagtgttatagatggcattcttgatatggtatttaattccaaagcatatgaagtaccgtggatttctgagaaattgatggaattatcgaaaaataaagacttggatattgccggattatcgctaacctgtttcggacatctcgccaggctacattcaaatatcggtgattacgataaagttattcctttactacattcaaagcaagatgatccagagcttcaaggtagggctgaagatgcgttagaagatatttctttatttttatctgaaaatcattaggaaccgtaggtcgggttgaaaacccaacaatcaaaatgccgtctgaaaccgtgtttaattttcagacggcatttctttcatttgaaataggatattgagaactgagttcttcaaaaatcctacacttgctccttccacggcagcaccttggtcaaaacggcagacggctgaaaagcaaacaccgtccgtcgtgttgccgtttgcggatgagtacgggtcaaccccaatgccgccgaaaccgtcgaagccgccttcaacattgccgccgccaaagccgcaaagttggcaaaaacggtaaaaccggggagataaaagccgatggcaggaaagtaaatgtgaggatagacagtacggaggcagacctgctttatccggcagggcaataagaaaacaaaaattagatatggaaaacgattgtgaagattaaaccattacaattttctaacaataatcacagattttatgtggacaaaatttgtgttaccgaacaagatgtgaacattttggcatccgaccgaaattatgaattaaatattgaaatatttattgacaatataattcattttcaaataacggatgaatcttataaagtaaaattttcagaatatttatttgaaaataaagaaaaaaatgattgggatagaaatcctgctataaattattttttcgagataatagatgatagttatatggactggttgaaagaagaaagttttgatttttttgaaaagaaatattataaggcttatattttcttttttagcgattctgtaatagaagttatcagctcgacagaacctgtattttattcaaaataacaaattatcaaacaaagctctgattaaaaacccaacaatcaaaataccgtctgaaacgatattcggctttcagacggtatttttgacacaaagcaggtaaccaaaggagtgtttgacggaaaaggagaagctaaaataccggatgtatcggttgggaagcaatggataaaggtaaataattatgtggaaaattagtaaagaaaattgtgaagatttaggatttgcaatagtctgtatgttctatgatgctattaatctttctgaatttaaattatggttggatatagttgtcagagatattcctattgatacaattccattgtatatttttgatttgattgattttgataagagtataggggaaatttatgatgtaattggagtcgttaattatggttacatttcaaatgatcaaaaaaatgcattaacgggcattgccttcttaagggggatagatgtctatgatccgcctatttcaaaagaaaaagcattaaaagccttagagaaatatcctgaaatttatcagaggtttcagcatttctttccttttgtagagcttccgcttttttaaaagacaatatgccgtctgaaaagttttcagacggcattttttatttcttccagtaggcgggggtgaagaggatgaagacggtgaagatttccagcctgcccaagagcatggcggtaacgcagatccatttctgcatcacgtccaaaccggcgtaattgccggcgggcccgacttcgcccaggccggggccggcgttggtgatgcaggcgatgacggcggtgaaggcggtggtaaattccataccgctcgccatcagcaggaagctgaagaggacgacggtcataaagtagatgaagatgaaggacataacggtcagcgcgaggcggtcgggtatggccttgccgctgattttgacggtgcggacggctttggggtgcagcagcaccatcatttcgcgcaggctgaatttgaacaggacgagggcgcgtatggttttgatgccgccgccggtcgagccggagttggcgaggatgttggcgaggaaaaacatccacagggaaatcaggagcggccattgtgcgaagtcggtgttggccagcccgtttgccagtccgatggagacgaagttgaaggcggtgtagcgcagggattcggtaaaaccggcgtaatagccggtgtgccacaggtacagggcggcggcaaggatgctgccggagagcagcagcagcatcgtccggcattcttcgtctttccaataggttttgaggctgcggctgttgagggcggcgaaatggttggcaaaattgatgccgccgacaatggtgaaaacgatgatgaccgcttcgatgaggggggagttgtaataagctatgctggcatcgtgggtggaaaacccgcccagcgagagggtagccatcgcgtgacagacggcatcgaaccagcccatcccggcaaaatgcaggcaggctgccgcgaggatggtgatcagggtgtagccgaaccaaagttttttcgccacttgggaaatgcgcggcgacattttgctttctttgtcaatgccggggatttcggctttgaataactgcgtgccgcctacgccgagcataggcaggatggcgacggcaaggacgatgatgcccatcccgcccagccagttgagcatatgccgccaaaagttgacggagggggcgagcccgtcgacgtgggggatgacggtcgcgccggtggtggtcagtcccgacatcgattcaaaaaatgcgtcggtaaagcccatattcgggaaatacaggtacatcggcatcgcagccatagcggcaaacgccagccacaacatcaggacgagggtaaagccgtcgcgcgggcgcagttcgcgcctgaaccggagggtggcgagccggacgatgcacgagccggaaagggtaacggtcgcggtggtggcgaaggcggtgtacgcgccgtccgaaaaggcgtaggagagggcggcgggtatcagcaggataaaggaaaacagcatacccagtcgggagaggacgtgggcgatgggcaggattttgtgcatagtggggcggtccgttattttgcgaagcttttccagtctatgccgccggcggcttggacttgggtaatttcttccgtttcgaggttgacggcggtcagctgtccgccccacagcgcgccggtgtccagcgagatgacgttgtcggcattcgtgtagcccagcgaggaccagtgtccgaagatgatgtgcgtcgaggttttgccggtcgggggctttgaaccacgggcgcaggtaaggcggcatttttttcactgtggatttgtagtcgaaatccagttcgtttttaaaggtcagggcgcgcatccgcgtgaaggcgttgacgatgaagcgcaggcgggcatagcctttcaaaccttcgtcccacgcggccggtttgttgccgtacattttggagaagaatttgacgtattttttgccgcgcagttcggcttcggcttctctagcgagcgattcggctttggttatgcgccattgcggcaggatgccggcgtgtaccatcacgcggctgccctcgcgtatcaacagcggttgcgcacgcagccagtcgagcattttttttccgtcggggtgtttgagtatgggttcgattgtgtcgctgcgtttgggcgcaccttcgccgcagccgacagcgagcaggtgcaggtcgtggttgccgaggacgatttgcacgctgttttcgtgccggatgcagaattgcagcgtttcgagggatttcgggccgcggttgacgatgtcgcccgtcagccagagggtgtccgtgccgtggttgaaaccgattttgccgagcagcgcggtcagttcgtcgaaacagccttgtatgtcgccgattgcgtaatgtgccattgcagatgttgtgaagtgggaaagtgttgcggttcggacggcatggttttgaaatatcatgcagtccgaacgtggaattatgcgttcaaaacgaggacggcttcggcttcgacctgcacgcctttgggcagcgaggcaacgccgacggcggcgcgggcggggaagggctcggcgataaattccgccatgacttcgttgaagacggcaaaattgcccaagtcggtcaggtaggcgttgagtttgacgatgtcggccagcgtgccgcctgccgcttcggcgacggcttgcaggttttggaacacttggcgcgcttcggcgcggaaatcgccgttgccgacgacggtcatcgtggcgggatcgagggggatttgaccgctcatgtaaacggtgtcgcctgctcggacggcttggctgtacgcgccgatggcggcgggggctttgtcggtgtggatgatggttttggacatttcggattcctcaaaaaatagggcggcagaagccgcagcattcgggattatcgtacaaaaccgccggcttgtgtagttgcggtggcagaaaacaaaaccgccgaaggctcggcggtttgcagaataaggcgcatatcagaatttgacgcgcacaccggcggacagttcgccggaacggacgtttttgacagtgttgactttgccgatgtagttgtagcggtagccggcatccaaatcgacattcggggtaacggcatagcttacgcccgtcaatacgccgaggccgatggaggtttggctgaagctgtcgctgccgcccaagtcgacggaggcgcggttgaggctcaagcgcgcgccgagatacggtttgacgggcgattgggtgtcgaagtcgtaaatggcggacgcgccgatgctgtaaagtttgaaatcggtggatggggctttatagtttttgtagcgcgtgtaatcgacggcgaagcggaggtcgttgatgcggtagcctgcggagatgcgcgggctgaagcctttggcagaacctaaagagcttgaggcttttgcgtgtgcggcatcggcttggacgtaaaagccggatgcgccttccgccagtgcggcggccgggagagcgagggcaatcagtgtggcaagtgcttttttcatattttggttcctttatggtcagttagaaaaattgttaagaatccgttaaagaatcctgctgtattatacttaaattttctttttgcatcgtaatattttcaatacttcaagatacgtagcggtatccggctgctttgccgacggcaaagccgttaacccgcgcgttgcctttaaatggtggcggcggcatcacgcggcggatgggtgaaacttgcaaacggtttggaaaaaacagcggtatctgtcggattgttgcaggtgcaggcatacggttttgtgtgcgtctgtgccttaagcgtcggacatttccggcggcggctgtgccgtctgaaacgcccggcgggggatgcggctgcgttttccatcgataagcatattttccggacgcgttcggggcgggttttcccgggcggccgccgatttgtttgcgcttatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaaaaacactgcagcaaatcgtttaaaaacaagcgtcctttttcggtcgggcggaatacggcagggtcggtttccagcaggcctttttgccttgccgtttcgatttgcgccatgattttggcactcggtacgcccgtgcgctcctgcaacatcgcggcgggtacgccgtcggtcaggcgcagggcgttcatcatgaattcgaacggcaaatcttcggcagcgacggttttgcgttcgacggcttcactcggttggctttgcattaaggcgaggtagtcgttggggtggcggcggcggacggtgcgctcgatgcggtcgggataggaaattttgccgtgcgcgcccgcgcctatgcctaaataatcgccgaactgccagtagttcaaattgtggcggcactgcatggctggtttcgcaaaagccgatgtttcgtagtggacaaaacccgcgccttccagcgcgccgtgtaccgcgtcttcgatgtcgagggcggcttcgtcttgcggcaaacctttcggcggcgtatgaccgaacggcgtgttcggttccatcgtcaggtgatacgcgctgatgtgggttgcgcccgtagcgatagcggtttgtacgtcgtccaatgccgtctgaacggtttggttcggcagggcatacatcaagtcgatattgactttatcaaataatttcaaggcggtatcgatagcggttaaggcttccttaccgttgtggacgcgccccagccttgagagcatatcgtcgttgaaactctgtacgccgatagaaagccgcgtaatacccgcgtctttaaatccttgaaacttctcgatttcaaatgtccccggattggcttccaaggtaatttccgcttccggctgcaagcgcaacagcgaacgcacgccgcttaacaaacggtcaatcgattccgcctgaaacaggctgggcgtaccgccgccgaaaaagatcgtttccaccggcctgccccaaatattgggcaattcaagctgcaaatcggtcagcagcgcgtcgatataggcggcttcgggcaatccgtttttcaggctgtgggaattgaagtcgcaatacgggcattttttgatgcaccacgggatgtggatgtaaagcgacaggggcggcagggcggtgagtcgggtgcggtttggaaaggaaatggtgtgcatggtgtggttcggaaaagtgggcaatgccgtctgaaggcggttcagacggcatgggttcagccgagcagggtaagcagttcggcttcgctgaggacggaaacgcccaaggcattggctttttccagcttgctgcccgcggcttctccggcgacgacgtaatcggtttttttggacacgctgccggaaactttgccgcctgcggcttcgattagggattgggcttggtcgcgtttgagggtgggcagggtgccggttaacacgaaggttttgcccgccacggctttattgatgccgtctgaaccttgcgccgcctcgtcttcagacggcatttgcgcgaagaaggttttcaggttttcgagcagggcggcgttttgtggttcgctgcgccacgcctgccagtcggtggggagggctttgtcggtttgcagcccttctatgtttttgccggcgagttcccataaggcttgggctttgttttcgctgattttgaaaccgggcaggcgggcgatccagcgttgcggttcggcgtggcgggcgggcgggatggtaacggcttgggtttgcggggcaacgcctgcggcgagcagttcgtctatcatcgcctgctgttcggcttgggcgaagaagtgggcaatggaacgcgccactaccgtaccgatgtcgggcaggcaggcgaggacgggttcgggggcgcggcggacgcgttccaatgtgccgaatgcctgtgccagcgttttggcggtgcgttcgccgacgtggcggatgccgagcgcgaacaggaagcgggcgagttcgggcgttttgctggcttctatgcctgcgaggatgttttccgcccacttgactggttgttttttatgtttgcccgacgcgccgaccgaactgccttcagacggcatttgatccgattcggcaacggttttgtccgctgtttccttcattttttgcaaggtcgggatgtcgaggcggtagagatcggcgaagtggcggacgaggtcttgcgcgacaagctgttcgatttgtttttcacccaagccgtcgatgtccatcgctttgcgcgaggcgaagtggattaagccttgcgcgcgttgtgcctgacaaagcataccgccgctgcatcgggcgacggcttcgccttcttcgcgttcgatttcgctgcggcagatggggcagtgggtcggcaggcggtagggcttgtggagcggaacggattgggtttgattggcggacggtgtttcggcaaacaaatcgtcctgccgatgcccgatgccgtctgaaacggcaacggcggtttcccgcatcgggcggcgttcaaaaatcacgcgcacaacttcgggaatcacgtctccggcacggcgtacgacgacggtatcgccgacgcgaacgtctttgcgcgatacttcgtcctgattgtgcagggtggcgttggtaacagttacgccaccgacgaatacgggctgtaatcgggcaaccggcgttaccgcacccgtcctgccgatttgcacgtcaatcgcttcgacaatggtcagggcttcttcggcagggaatttgtgggcaaccgcccaacgcggcgcgcgggagatgaagccgagttcgtgctgttgcgccaagctgttgactttgacgaccatgccgtcgatttcgtagggcagttcggggcgtttttgctgcatgtgttcgtaaaacgccaatacttcgtcgatatttttgaaacagccgaaattgccattgggcagactgaagccgagtgcttggaaataggcgagttcctggatgtgttcttccgcgacgaaaccatcttgctggcgggcgacggagtaggggaaaaagtgcagtttgcgttgcgcggtgatgcgcgaatcgagttggcgtaggctgccggcggcggcgttgcgcggattggcaaagggtttttgcccgttttcggcttgtcttttattgagggcgacaaaatcggctttgagcatcagcacttcgccgcgtacctcgatgagttcgggcgtattttcgccgtgcagccgcaaggggatgttggatacggttttgatgttttgggtaacgtcttcgcccgtcgtgccgtcgccgcgcgttgccgcctgcaccaatacgccgtcgcggtagagcaggctgatggcgaggccgtcgaatttgggttcgataacgtattcgggattgccgccgtccaagccgtcgcgcacgcgttggtcgaaggcgtacatttcggcatggtcgaacacgccgttttcatcttgcggggaaaaagcgttggtcagcgacagcatcggcacttcgtggcgtacttcggcaaatcccgccaaaggctcgccgccgacgcgctgggtcgggctgtcgggcagtttgagctcgggatggtttaactccaacgcttcgagttcgcggaacaatttgtcgtattcggcatcgggtacgctgggcgcgtcgagggtgtagtattcgtaggcgtagcggttgaggaggtcggtgaggcggcagatgtgttgtgcggcaaattgttttatatcactatcagacggtttaagaagattggtaaagttagtgttatgttttgagtttggattcatgagagaaggttttcagacgacctttgtctgatacgggatgaaacgggcaaaggtcgtctgaaaaatgataggttgaaaacagctgaattttacccgaaaaaaagcggatatgccgtaacgacatatccgctttgattgcattcgattttaggagaacaggcgcaatgcggttttgccgcccggttcgataccgactttgagcatctcggactgacgcgccaatacataagtgcgcacgtctttgagccattgggtcgaaacttcttccattttgtcgttgaccagattcaggttcaactggccggacaggcgtaccgccaaatccataaacaaatcgtcgaaggttttttcgcctgccggagagtgcgggatgtcgagcagcatactgaagcctttgtaggactggttgtccaaaagggcgttggtaaacggctcgttgttgagcgagcagatggagaacatggtcgagcccgacgtgtcggtatagtggaacgcgccgtcgtcttccaaaacgaaacccacgcccgttacggcggaacgcagttctacgccgctgatgctggtcggggaaaccaaatggatggcgatggtctggtcgacgcgcgcgcagaatgcgtccagtgcggaagccacttcgataaaggcggcaaggtcggtgtgcagcgtctgaccgcccatgctttgtgcgaatgcgtccacctggcggttgaatgcggagagttcttcctgcgaggcaagtccgttgcggctgactgcctgaatacccacgataaatgcctgatagcggatgcccgggatgggttcggcaatctggaaatggtcgtccatggtgcagccgacaatctggtagcggcagcggttggaaaggcgcggcagtgcgtgcagttctttggcttcggtcagcgcgatataggagatgaagtcgaagcgcacgtcaaaccagggtaattcgacttttgacagttctttgagcgtaatcagcggttttgcaggtgtttgcggaacgggtgcaggttttgccggcgcgtcggcaggtttcggtgcggaatgtccggtttggggttcggaaacggtgtgggcggagttgccgataatgccgctttcttccaaggcggtttcgatttcggttttgaacggggaggcttttgcctgtttctgcttggcgatgtagacggcatcctgttcttgcaggttgcgcatggcggggtcttggggttttgccgtttttttgaccgccggttggggtttcggcatcatgactgacccgccggacggtttgccgtcgcggacatggctggttttgctgttgagcagggcatctttgtcggagtgtccgaactggtcgcgcacttttttgcggtattggttttcctgatacatgttgtaggcgacaacggcgaggacgacagctagaaacagtacgatgtaaatcatggcaatcacttgttaaatttcgggatgcaggatacgcaaagtgcgggtactgcggttaaatcgggcttgcactgcggttaaatcgggcttgcgtttccggcagtctgacggaacggccgattataacgtttgaattataacgaaaattgcagggtctgacagcagtgtgtcgaaataagcggaaattttccgaaatgccgtctgaaatctgtggttttcagacggcatttctgtccacgagaaaccctttctcccgtatccgccgccagtcgaaaaaatggccggggtcggttttgcggccgggcgcgatgtcttggtgccccgttaccgccgtgacggggtagtggcggcagattgcgtccaacaaggcttcgagcgaacggtattgcgcttcggcaaacggttcgaaatcgcagccttccagttcgatgccgattgaaaatgcgttgcatttttccctgccgccgaatgaagatacgccggcatggtatgccatattgtcgcaggaaacgaactgtaccgtttctccgtcgcgtttgattaagaaatggctggatacgcgcaaagtgtgtatcaggctgaagaacggatgtccgtcggggtcgagccggttggcaaacagcttttccaccgcatccgtgccgtattcgaacggcggcagcgaaatgttgtgcaacacgatcagggaaaccgtttcccccgtttccctcgggctgaaattgggcgacggggtatggcgtatgctttgaagccagccgttttgccagtgtgcttcggcgtgattgtccatgatgttcttcctgtccggcgggcaatttgggttatactgtcgcccgaattttaagacgtattccgaatgctgggaatcctaccatgttgagaaaattgttgaaatggtctgccgtttttttgaccgtgtcggcagccgttttcgccgcgctgctttttgttcctaaggataacggcagggcataccgaatcaaaattgccaaaaaccagggtatttcgtcggtcggcaggaaacttgccgaagaccgcatcgtgttcagcaggcatgttttgacggcggcggcctacgttttgggtgtgcacaacaggctgcatacggggacgtacagattgccttcggaagtgtctgcttgggatatcttgcagaaaatgcgcggcggcaggccggattccgttaccgtgcagattatcgaaggttcgcgtttttcgcatatgaggaaagtcatcgacgcaacgcccgacatcggacacgacaccaaaggctggagcaatgaaaaactgatggcggaagttgcgcccgatgccttcagcggcaatcctgaagggcagtttttccccgacagctacgaaatcgatgcgggcggcagtgatttgcagatttaccaaaccgcctacaaggcgatgcaacgccgcctgaatgaggcatgggaaagcaggcaggacgggctgccttataaaaacccttatgaaatgctgattatggcgagcctggtcgaaaaggaaacagggcatgaagccgaccgcgaccatgtcgcttccgtcttcgtcaaccgcctgaaaatcggtatgcgcctgcaaaccgacccgtccgtgatttacggcatgggtgcggcatacaagggcaaaatccgtaaagccgacctgcgccgcgacacgccgtacaacacctacacgcgcggcggtctgccgccaaccccgattgcgctgcccggcaaggcggcactcgatgccgccgcccatccgtccggcgaaaaatacctgtatttcgtgtccaaaatggacggcacgggcttgagccagttcagccatgatttgaccgaacacaatgccgccgtccgcaaatatattttgaaaaaataaaccatgccgtctgaaaagtttgtgttttcggacggcatacccttaccggaactgcaagcatgaaaccgcaattcatcactttggacggcatagacggtgccggcaaatccaccaaccttgccgtcatcaaggcatggtttgaacggagggggctgcccgtgctgttcacgcgcgagccgggcggaacgccggtcggtgaggccttgcgcgaaatcctgctcaaccctgaaaccaaagccggtttgcgtgcggaaaccctgatgatgttcgccgcgcgtatgcagcacatcgaggaagtcatcctgcccgcgctttcagacggcatacacgtcgtgtctgaccgttttaccgacgcgaccttcgcctatcagggcggcgggcgggggatgccgtctgaagacattgaaattttggaacattgggtgcagggcggtttgaagccggatttgaccctgctgctggatgtgccgctcgaagtgtcgatggcgcgtatcgggcagacgcgcgagaaagaccgtttcgagcaggagcaggcggatttctttatgcgtgtgcgcggcgtttatctcgaccgagccgccgcctgtcccgaacggtacgccgttatcgacagtaaccgcaacttggatgaagtcagaaacagcatagaaaaagtgttggacggacatttcggctgctgatgcggcaaatattgaaacaagcgcatccgcccgcgccgaaaatcaaacggcagtgccgcaggtgaaaatggcggtatgcgccaaactttcggcatgatagaattacgctcggttacaaggcaggatgcgtcggcaatattaacgaaccgcccgtaacatgatgacccgaaagcgtttcggacagtccgattcaaatctttttctcgcaacaggattgacacatggaaaactcattgaaagaagccgccctcaagttccacgaattccccgtgccgggcaaaatttccgttaccccgaccaaatctctggcgaccgacaaagatttggcgttggcgtactctccgggcgtagccgctccttgtatggaaatccatgccgatccgcaaaatgcctacaaatacaccgccaaaggcaacttggtcgctgtcatttccaacggtacggccgttttgggcttgggcgacatcggcgcgctggcgggcaaacccgtgatggaaggcaaaggcgtattgttcaaaaaattcgccggtgtggacgtgttcgacatcgaaatcgatgaaaaagacccgcaaaaactcgtggacatcatcgccgctttagagccgaccttcggcggcatcaacctcgaagacatcaaagcacccgagtgtttctacatcgaacgcgaattacgcaaacgctgcaaaatccccgtattccacgacgaccagcacggcacggccatcattaccgccgccgccgtattgaacgccctgcgttttaccggccgtaaaatcgaagaagcgactttggtgtgttccggcgcaggtgcggccgcgattgcctgcttgaaccaattgctggatttgggcttgaaacgcgaaaacgtgaccgtttgcgactccaaaggcgtgatttaccaaacccgcgaagacaaagaccgtatggacgagtccaaacagttctacgccattgaagacaacggccagcgcgtgcttgccgatgccgtcaaaggcaaagacatcttcttgggcctctccggcgcgaacctgctgacgcctgaaatactgaacaccatgaacgaaaaacccatcgtgttcgctatggccaacccgaatccggaaatcctgccgccgctggcgaaagaaacccgtccggacgtggttatcggtaccggccgctccgacttcccgaaccaagtgaacaatgtattgtgcttcccgttcatcttccgcggtgcgttggatgtcggcgcgacgaccatcaacgaagaaatgaaacgcgcctgcgtgtatgctttggcggatttggcgatggaagaagtaaccgaagaagtggttgccgcttacggtaagaaatttgaattcggcgcggaatacctgattccgactccgttcgattcccgcctgctgccgcgcgttgctacggctgccgccaaagcagcgatggaaagcggtgtggcaacccgtccgattgcagatttggaagcttacgctgccaagctgagcgaatggaagctgtaagccgtttgcggtttaaaatgccgtctgaactgttttcaggcggcattttgctgtcagattgatatagtggattaacaaaaatcaggacaaagcgacgaagccgcagacagtacaaatagtacggaaccgattcacttggtgtttcagcaccttagagaatcgttctctttgagctaaggcgaggcaacgccgtactggtttttgttaatccactataaatgaaagatactgaaaaatgaaagagatgaaacctgtccgttatcatattggcgatatgcccgagacttcaaaacaaaccgcctcccgtcatgacgacagggcagtgggtgttgacgatgattgttttcatgattcctttggtcaatttttgtttgggtgttcggcagaggcaacccgaaccgcgccaatttctgtaaagcgcagttgcttatttacctgattggttcgcttatcggtttggtcttcgcgttgtttataggtgggtctgtatcaggtacgcatgattaatgccccgggctgattttgcttcgaggatttgtatcgaatatgccgaattgtttcaaatttcataccgttatcgaacggcattggcaaaaaccttatccggttttgtcttttctgcttaagccgctctccgggctgtttgccaaaattgcggcaaaacggcggacggattttttatcgggaaaacggcaaagcgaaaagctgcccgtgcctgtggtcgtggtcggcaatattcacgcgggtgggacggggaaaacgccgattgttgccgcgctggtgtcgggtttgcaggaaaagggcgtcaaggtcggcatcatcagccggggctacgggcgcaagagcaaggcggttcatgtattgaatgctgagagccgagcggaagatgcgggcgatgagcctttgctgctgttccgcaaaaccggtgcgccgacggcggtgggcagcagccgtgcagaggcaggcagggcgttgctggcggcgcatcccgacatcggactgattgtggcggacgacggtttgcagcattacgccctgcggcgagatgtggaaatcgcggtgtttccggcggcggatacggggcgcacggatttggatttactgcccaacggcagtttgcgcgaacctttgttgcggctggattcggtggatgcggtcgtcgtcagcggcggcaaggcggatgcgctgtttaggccgtctgaaaatatgtttcacagccgtatcgaagcgggacggatttaccgtttgaacaatccgtccgaaatactggacacaggccgtctgaaaaatcaaaccgtcgtcgccgtggcaggtattgccaagccggcgcggttttttgattcgttgcggaatatgggcattaccgtgaagcgaaccgtcgcgctgcccgaccacgccgacatttcggcggcagatttgcccgatgcggacgcggtcattattacggagaaagatgcggtcaaattttcagacggcatttgcaccgataatgtttgggtgttgcccgtttgtgcgataatcgaacctgatttggcggcgtttgtgttggagcggttggaagatgtaccgaaggccgtctgaaagcacggtttgggcggagtgattacggatttgaataagaacgcctcgcgccatcattcccgcgcaggcgggaatctaagtctcgaattttcaggaatgcctaggaggctccagaaatcccaaatctccggatttccacttggacaggaatgagaaaaccggtcgtattttttatctgcattaatcattcattaaaggattgaatattaaactgaaaaccttgttattgcccttcgccacgctggcattgtgcaccaatgcttttgccgccccgcccagcgacgcgtcgttggcgcgttggctggatacgcagaattttgaccgggatatagaaaaaaatatgattgagggctttaatgccggatttaaaccgtatgcggacaaagcccttgccgaaatgccggaagcgaaaaaagatcaggcggcagaagcctttaaccgttatcgtgagaatgttttgaaagatttgattacgcccgaagtgaaacaggctgtccgcaatactttattgaagaatgcccgtgagatatacacgcaagaagaaattgacggcatgattgccttttacggttcgcctgtcggtcagtccgtcgttgccaaaaatccgcgcttaatcaagaaatcgatgagtgaaatagcggtatcttggactgcattgtcagggaaaatcgcgcaacatcatctgcccgagtttacggaagagttgcggcgcatcatctgcggcggtaaaaatcccgatgcgggctgtaaacaagccggacaggttgggaaaaggcatcagaaataaatgatagccgtctgaaatattgaagagggcatccgattgattgaaccatcaaacccgaaagcaaccctatggaaaaaaaattcttagacatcctcgtctgccccgttaccaaaggcaggctggaatatcatcaggacaaacaggaattgtggagccgtcaggcgaagcttgcctatccgattaaagacggcattccctatatgctggaaaacgaagcgcgagcgttgagcgaagaggaactcaaagcatgaccgaattcgtcgtattgattccggcgcggctggattcgtcgcgcctgcccggaaaagccttggcggacatccacggcaaaccgatggtcgtgcgcgttgccgaacaggcggcaaaaagtaaagccgcgcgcgtcgtcgttgccaccgaccatcccgatattcagacggcctgtcaggcgcacggtatcgaagtcgtcatgacttcaaaccggcacgaaagcggcacgacgcgccttgccgaagcctctgtcgcgctgaagctgccgccgcatttgattgttgtgaacgtacagggtgacgagccgctgattgcccccgaactcatcgaccgcaccgccgaagtactcgtcgaaaacaacgtccaaatggcgaccgccgcccacgaattgcacgatttcgacgaattgatgaatcccaacgccgtcaaagtcgtcctcgacaaaaaccgcaacgccatctacttcagccgcgccccgattccctatccgcgtgatgcgatacgtgccggaaaacgcgaaatgccgtctgaaaccgccgtcctgcgacatatcggcatctacgcttaccgcgccggcttcctgcaacgctatgccgaaatgagcgtttcgccgctggaaaccatcgaatcgctggaacagctgcgcgtcctgtggcacggttatcccattgccgtcgaaaccgccaaagaagcccccgccgccggtgtggatacgcaagaggacttggacagggttcgcgccgtatttcagaccgtataaaacaggttcaaagggaaaagatatgcagcaacatattgaaaagtggcaacacttgagccgggaagaacagaaaatccttgctgaagtatggggtctcgtgcaaaacgacgatcaggaggttcactatgaaatgctcaaattgaacgcacccgatgaagccagcggcgaattttggttcagaatggcagaaacactcagcaccctgccgcccaaccgttccctcggccttagaatgaacggcggcaggctggcgaccgccgtatccatcctttccgtcatgattgaagacaatcccgacataccgcagctttgggcgcaaaaaattaccgcgctcaattatagtggattaaatttaaaccagtacggcgttgcctcgccttgtcgtactatctgtactgtctgcggcttcgtcgccttgtcctgatttttgttaatccactatatttggcacacgggcacaaagcccgtgccgacggtttggcacaacagcccgacaaagcggcagaagccaacgaggaggaatacctgaccaaagccctgtcgcaaaacctgctgtcaacattggatgtcgcgcttgcacgttttcctgaagacgcgtggtttcaggaaatcaaacaggatgcacaaaagcattttgcttgaggatgtggcagtcaggaatatttccattcaggaagaaaagaagtgcctgattgggtataatcagggtaaatcttattttatttcaaaagattaatatttgctttctgtttttccttgacggtatcggaaaagttgattatagttacagcttccttaggagtaatggctgagaggctgaaggcacttccctgctaaggaagcatgtggggtcaacctgcatcgagggttcgaatccctcttactccgccagataaaaaatagacgctgtgttttacagcgtctattttttatgcaattttatagcgggttggtgcaaaaccagtatggtattgccctgtcttgattctgaattttgttatagtggatgaacaaaaaccagtacggcgttgcctcgccttagctcaaagagaacgattctctaaggtgctggagcaccaagtgaatcggctccgtactatttgtactgtctgcggcttcgtcgccttgtcctgatttttgttaatccactataatccgagatgcttgccgtttatttccgcctcgttcaaacggcggctctgatttgcgcggtttctgtttgccgtattcgcctatccgtaccgcaaatgttatactgggaaaaatttactgattgtgttttacggcatatttgccgataggatggaagagacaaatgagcagaatccggcaggcttttgccgctttggatggcggaaaggcattgattgcctatattacggtgggcgaccccgatattcggacaactttggcattgatgcacggcatggttgcaaacggtgcggatattttggagttgggtgtgccgttttccgatccgatggcggatgggccggttattcagcgtgcggcggagcgggcgttggcaaacgggatttcgctgcgcgatgtcttggatgtcgtcagaaaattccgtgaaaccgacacgcaaacgccggttgttttgatgggatatttgaaccctgtacataagatgggttatcgggagtttgctcaggaagccgcaaaggcgggtgtggacggcgtgttgacggtggattcccctgtcgaaaccatcgatccgctctatcgcgagctgaaggataacggggtcgactgtattttcctgattgcgccgacgacgacggaagaccgtattaaaaccattgccgagctggcaggcggatttgtctattatgtttcgctcaagggcgtaacgggcgcggcaagtttggatacggatgaggtttcgcgtaaaatagagtatttgcatcagtatatcgatattcccatcggtgtcggtttcggcatcagcaatgcggaaagtgcacgcaaaatcggccgggttgccgacgcagttattgtcggcagccggattgtgaaagaaatcgaaaacaatacaggcaacgaggctgccgccgtcggtgctttggtaaaagagttgaaggatgccgtgcgctgacggcggttcctcatcctgaatattttaggagttgtccatgagctggttagataaaatcctgccacccaaaatcaagaatcgcggaaaagacggttcttccaatgttcccgagggtctatggcacaaatgcccgtcttgttcggcaaccgtttattctaccgagttgcagcagaacaatcaggtttgtccgaaatgcaaccaccacaatccgttgtcggcacgacaacgcctgaacctgcttttggatgaggatggcagggaggaagttgccggaaatgtcaaaccgacagatcctttgaagtttaaagacggcaaaaaatatccggatcgtttgagtgcggcacgcaagctgaccggggaagatgatgctttggtggtgatgaaaggcaagatgaacggcctgcccgtcgtcgttgctgcgtttgagttccgctttatcggcggttcgatgggttcggttgtgggcgaacgattcgtacaaggtatccgtcgggggtatgccgacaattgtccgttcgtctgtgtgtcggcttccgtcggcgcgcgtatgcaggagggtgtaaactcgctgatgcagatgacgaaaaccagtgccgcgctgcatttgctgacggaaaaacgcctgccatttatatcggtgttgaccgatccgactatgggcggcgtatccgccagcttcgcatttttgggcgatgtcgtgcttgccgaaccgaacgcgctgatcggttttgccggtccgcgcgtgattgagcagacggtgcgcgaaacgctgccggaaggcttccaacgcgccgagttcctgctggaaaaaggcgcaatcgaccagattgtcgaccgccgcgatatgaagcggcgcatcagtgatttgattacgctgttgtgccgtcaggacaaagtttccgccgcctgatggctgatgaatcgagtaccgtctgaaaccgatgtttcagacggtatttttgtgtctggttatttgttgtgcggctttatcgatggggcatagcgtccggcacgttctttcaggcgttgtaccaaacctttcgtgtcggcgggtacaccgccctcgcagaatgcctgatacaggacggtgcgcagtgcgtcgttgcggcttaatgtaccgcctatcggtttccattcggcgtttcggggctgtatccagcggcggttgaccgtgtcgccgtagccgaacactttataggaggaaggtttgccgttgccgaacctgatggagaagcgggcgcagaatatgcctttggcagtcaggttgtcgtagcctttgtcggagcggatattgagaatgtagcggatgctgccgtcgggcgcgggcataatttgcaggctgtcgagcaggattttcggctgtttgccgtaattttcatccacataaatgtcgaaccagccgtccgagtgcgtatcgggcagcggcggcagtttggcggtatgttctttaaattcgcgggcggcggcctcttcgggcgtttcgcggtagcgggtgttgatcggcgtgtctttttggctgaagccggcagcgagggacgtgccggcggcgagtgcgagcagcaggagggcggtgcggcgcataagtttctccaaattgaaaacggcgttattttatgggttggcaaagggggctgcaagcaactggggtataatctccccccgattcccattttttaaacggtacaaacgatgaacagcgaaactttagacgtaaccggattgaaatgtcccctgccgattttgcgggcgataaaggctttggcgcaaatgcagcacggcgacctg

SEQ ID NO: 37803 - DNA, 1041 bp, Neisseria meningitidis
agacaaactttttgaacagcatgacggcaaactcgaaagcatggacgggcgggaacaggagctggatttgatttggcggacagaagccgatatcggtaacggcagcatactgcaatttgtctgcaactggggtttccccgccgcccgaaaagacctgttccgttctgaaaaaaatcggcgcggtacacagcgcaatgctgatccatcgggcggcagacgcattggacaaagaaatccgccgcctccaatcggaaggtaaaaacctgaaagaaatgtgggatataacatctcgacaacaaaaccgcctcactgctgaacagtctggatgaacaatattggcaagaccccgacaaactgtatctgctgggatggcaatactattccagcaaccctgttcagacggtggcggattcgcatttgaagtgcaactttccctaacagaaaaaggccagtatgcggtagcatacggcctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacccccttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacataaaagc

SEQ ID NO: 37804 - DNA, 5034 bp, Neisseria meningitidis
ccggcaaacaccggcgcgtcccatccgtgcagaaaaaaggatacggaaaaggataaacgccataacgtgcggcgtttgctataatccgccccttcattaccgcagcccgccgaaagatgccgatggcaaaaccgctcaaataccccgtttccgcactggtcgtcctttatagcggggacggcggcatcctgctcatcgaacgcacgcatccggaaggattttggcagtcggtaaccggcagcctcgaaccgggcgaaaccgtcgcccaaacggcaaggcgcgaagtttgggaagaaaccggcatcctgctggcggacgggcagcttcaagactggcacgacagcacggtttacgaaatctaccaccactggcggcaccgctatccaaaaggcgtgtttgaaaaccgcgaacacctcttctctgccgaaatcccgcgtgatacgcccatcgccctgcaacccgaagaacacgtctcctacggttggttcgatatggaagaagcagcggaaaaagtattttccccgtccaacaggcgcgcgattttggaactgggcaggtttttgggcaaacggtaacacgcgcccgtacaccctttcagaggcatcgggcgcattttcagccggacgtttgtgctatactttcaaacttcacactttcccaaacaaaggaaaccaaatggcagacttcaaccaaatcctgacccccggcgacgtggacggcggcatcatcaacgttgtcaacgaaatccccgccggcagcaaccacaaaatcgaatggaacgcaaactggccgcattccaactcgaccgcgtcgaacccgccatcttcgccaaaccgaccaactacggcttcattccccaaactttggacgaagacggcgacgaattggacgtgctgctcgttaccgaacaacctttggcaaccggcgtattcttggaagcgcgcgttatcggcgtgatgaaattcgttgacgacggcgaagtggacgacaaaatcgtctgcgttcctgccgacgaccgcaacaacggcaacgcctacaaaactttgtccgatttgccgcaacagctcatcaaacaaatcgagttccacttcaaccattacaaagacctgaaaaaagcaggtacgaccaaagtcgaatcgtggggcgatgcggaagaagcgaaaaaagtcatcaaagaatccatcgaacgttggaacaaacaggcataacgcccgccatgccgtctgaacgccgtttcagacggcatttttccaagctctagggaataccgtcccaatcggctataatccgaacataccgtttccgaccgaacgccatgaaccgccgaaaaatctatctgttgtctgttgccctcttcacactggcatttatgctgctcgtcctcttgggtgcttatctgctgaccgtcggcagcaaagccttcgccgtcgcctcctttcttttcgcattcggcgcactgttcggacaaatcggcagcctcgccctctacctgcggcacaaatccctacgcgccgcccaatccgccacaaaggaaaaccgctatgtctgaaaaaccggaaaaaatcgttttggcaagcggcaatgccggcaagctcgaagagttcggcaacttattcaaaccttacagcatcaccgtattgccgcaatccgcattcggcatacccgaatgccccgaaccctatcccacctttgtcgaaaacgcgctggcaaaagcacgccatgccgccaaatacagcgggctgcccgcactcgccgacgacagcggcatctgtgccgccgccttaaacggcgcgccgggcatccattccgcacgttacgcgggcgacaatcccaaatccgataccgccaacaacctgaaacttgccgccgaacttgtcggcaaggcagacaaaagctgctgctatgtctgcgtattggtttttgtccgccataaagacgacccgcgcccgattatcgccgagggcgtatggcacgggcagtggaacgacacgccgctcgggcaaaacggtttcggttacgacccgtatttttatctgcccgaacacggcaaaaccgccgccgaattggatacggaggtcaaaaaccgcgaaagccaccgcgcgcaggcacttgccgaactcttacgcaaactcgccctttaaacatcaaaacaatacaaaggaaaaagaatgaaacccatacggaaagccgttttccccgtcgcagggatgggaacccgcttcctgcccgccaccaaggccagcccgaaagaaatgctgcccatcgtcgacaagccgctgatccaatacgccgtagaagaagccgtggaagccggctgcacggaaatggtgtttgttaccggacgcaacaaacgcagcatcgaagaccatttcgacaaggcatacgaactcgaaaccgagttggaaatgcgccataaagacaaattgttggaacacgtccgcaacatcctgccgccgaacattacctgcctctacatccgtcaggcggaagcactgggcttgggacacgccgtcttgtgcgcccgcgccgccatcggagacgaaccctttgccgttatccttgccgacgacctgattgatgcccccaaaggcgcgctcaaacaaatggtcgaagtgtacgggcgcagcggcaacagcattttgggcgtagaaaccgttgaagcatcgcaaaccggctcatacggcatcgtcgaaaccgaacagctcaaacagttccaacgcattaccggcattgtcgaaaaacccaagcccgaagacgcgccctccaaccttgccgttgttggacgctacatcctcaccccgcgcattttcgacctcttaaccaatcttccgcgcggcgcgggcaacgaaatccagcttacagacggcatcgccaagctgctcgatcacgaatttgtcctggcgcacccctttgaaggtacgcgctacgactgcggcagcaaactgggctacctcgaagccaccgtcgcctacggtctgaaacatcccgaaaccggcgaacccttccgccggcttttggaaaaataccgcaccgaataaccccatcaaggaatccttatgcacgacaaaacctggtccggacgtttcaacgaacccgtttccgaactcgtcaaacaatacaccgcctccatcggtttcgaccgacggcttgccgaatgggacatccaaggctcgctggcacacgcgcaaatgctgaaagaaaccggcgtgttggacgaaggcgatttggcggacatccgccggggtatggcggaaatcctcgaagaaatccgcagcggcaaaatcgaatggtcgtccgatttggaagatgtccatatgaacatcgaacgccgcctgaccgacaaaatcggcgacgcgggcaaacgcctgcacaccggccgcagccgcaacgaccaagtcgccaccgacatccgcctgtggctgcgcgaccagattaccgttatacaaagcctgattcaaagccttcagacggcattgctggatttggcggaacaaaacgccgaaaccgtcatgccaggctttacccacctgcaagtcgcccagcccgtcagcttcggacaccatatgctcgcctacgtcgaaatgctcggacgcgataacgaacggatggcggactgccgctgccgcgtcaaccgtatgccgctcggcgcagccgcccttgccgggacgacctacccgattcagcgcgaaatcaccgccgagctattgggctttgaacaaatctgccagaactcgctcgatgccgtatccgaccgcgatttcgccattgagttcacagccgccgcctcgctggttatggttcacctgagccgcctgtctgaagaattgattttgtggatgagcccgcgtttcggctttatcgacatcgccgaccgtttctgcacaggttcgtccatcatgccgcagaagaaaaaccccgacgtgcccgaactcgtgcgcggcaaatccggccgcgtcatcggacaccttatcggtctgattaccctgatgaaatcccaacccttggcgtacaacaaagacaatcaggaagacaaagaacccttgttcgacaccgccgacacgcttatcgacacgttgcggatttacgccgatatgatgcgcggcgtaaccgtcaaacccgacaatatgcgcgccgccgtgatgcagggcttcgctaccgccaccgacttggcggattatctggtcaaaaaaggcatgcctttccgcgatgcccacgaagtcgtcgcccaagccgtgcgccacgccgaccaagcgggcgtcgatttgagcgaactgccgctcgaagtcttacaaggtttcagcgatttgattgccgacgacgtttacggcgtgctgacacccgaaggcagcttaaacgcccgcaaccacttgggcggtaccgcgccggaacaagtccgcttccaagtgaaacgctggcgggaaatgttggcttaacccccaaatgccgtctgaagaaatgttcagacggcatttttaaaaggcaagaacacgatgaccgatacggatacccaagccgaccgcttcgaacagatgatgtggcaggcggtggacaaactttttgaacagcatgacggcaaactcgaaagcatggacgggcgggaacaggagctggttttgatttggcggacagaagccgatatcggtaacggcagcatactgcaatttgtctgcaactggggtttccccgccgccgaaaagacttgttccgttctgaaaaaaatcggcgcggtacacagcgcaatgctgatccatcgggcggcagacgcattggacaaagaaatccgccgcctccaatcggaaggtaaaaacctgaaagaaatgtgggatataacatctcgacaacaaaaccgcctcactgctgaacagtctggatgaacaatattggcaagaccccgacaaactgtatctgctgggatggcaatactattccagcaaccctgttcagacggtggcggattcgcatataacgtgggccaatctatgtataataggaattccagaaggagtagaaaaagataagggaatggaaaatagg

SEQ ID NO: 37805 - DNA, 17381 bp, Neisseria meningitidis
catgaaaatgcaggcagttgttgtgaataaaaatgtagcgggcgatgtggaagtaatcgaacgcgaggttcgcccgttggaatacggcgaggcattggtcgaagtcgaatattgcggcgtgtgccacaccgacctgcacgttgcggcaggcgactacggcgaaaaaccgggccgcgtgttgggacacgaaggcatcggtttggttaaagaagttgccgacggtgtgaaaaatctgaaagtcggcgaccgcgtcagcatcgcttggctgttccaaagctgcggctcttgcgaatactgcaataccggccgcgaaaccctgtgccgttccgtattgaacgcgggctacaccgccgacggcggtatggcgacccactgtatcgtgagtgccgattacgcggtcaaagtccctgaaggtttggatcctgcgcaagcttccagcattacttgtgccggtgtaaccacttataaagccattaaagtttccggcgttcgtccgggacagtggattgccatctacggcgcgggcggtttgggcaacttgggggtccaatacgcgaaaaaagtattcggcgcgcacgttgtcgccatcgacatcaacgacgacaaactggcgtttgccaaagaaaccggcgcggatttggttgtcaacgccgccaaagaagacgctgccaaagtgattcaggaaaaaaccggcggcgcacacgctgcggtcgtaaccgccgtatctgctgccgcattcaactctgccgtgaattgcgtccgcgcgggcggacgtgtggttgccatcgggctgccgccggaatcgatggatttgtccatcccgcgtttggttttggacggcatcgaagtggtcggctctttggtcggcacgcgcaaagatttggaagaagccttccaattcggcgcggaaggtttggttgtgccgaaagtccaactgcgtgctttggatgaagcacccgccattttccaagaaatgcgcgaaggcaaaatcaccggccgtatggtgatcgatatgaaaaaagaatgcggctgcggccatcaccactgatttgacgtggcagtacacatcgaaatgccgtctgaacgctgttcagacggcattttttatggatttggatttgattttaatctgttctgtttgaaataccgtctgaaaacccatatcgcaacacttcattaaaaacggcaagattcagccgttctgcaacccgttcaaacggcttccgccatttccaacgcctgtttgatgtccacggcgacgacgcgcgagacacctttttcctgcatggttacgccgaccagctgctccgccatttccatcgtcaggcggttgtgggagatgtagaggaactgggtttgcgccgacatttctttgaccagcctgcagaaacgcgaggtgttggcgtcgtccagcggggcatcgacttcgtccaaaaggcagaacggagcggggttgaggctgaacagagcgaacacgaggctcatggcggtgagggctttttcgccgccggagaggaggtggatggtgctgtttttcttgccgggcggacgcgccataatggacacaccggcggtcagtaggtcgtcgcctatcattttgagagtggcttcgccgccgccgaacagggtcgggaagaaggtttggactttgctgttgacggcatcgaaggtttctttgaaacgcgctttggttttgtcgtcgatttgggcgatggcttcttccaaaagggtgatggctgcctgcacgtcttcgctttggctgcggtagtagccgtcgcgttcgcgcgcttcttcgagttcttgcagggcggcgaggttgaccgcgccgagtgcttcgatttgttgcgaaaggctgccgatgctgctgttcaatactttcggcgattctttcgccaacgcttcgagcgcgtccaaatcggcggcgcgttcggtcaggttttgatggtagcgtttggcgttgatcagggcttcctgctgctgcaacaaggcggtttgggtggcggcctgaagctgcggcagcttggtttgcagggtttgcactttagcgtattgctccctgccctgttcctgaatctgcgcgagtttctcttgcacaacaatatattcttcgtccaaggtctgtacggcttcgcttaattcttcaagcttgatgtgctgctcgtcgttttggaactcggtttcataggcgagggcaagctcttgctggcgttcctgccagtcgagggtttgctgttcaagctgggcgatttgctgccggtagttttgtttttgctggttgagtttgtggacggcgacttcggcaagcccgtattggcggttggcttccaacagggcaagctgcgcctgtttcagacggccttgctgctcttggcggctgtgcgcggtggtttgctgctggtgttcgagttcggcggcggcttcctgcaaggtaacgatgtcgtctgaaagcccgtcggacgtgtgttgcaacacggtctgttcttccgccaactgcgccagttcgcgctcgatgtgttcgcggcggatttgcccttggttggtacgcgctaagagttcggcggcgcgttgctgtgcttgactgtattggcgcgtgtgctgctgttgctgctgcatcaggtttttatgttgcacttcagacgagcgcacggcagcttccgcctgtttgaacgcggcttcggcggcggaaagttcgggggcgaggttttccagttcggacgcgatgccgtcgaggcgcgctttttgggcaatcaggctttcctgcgcgggtttggcatagagcaggacgctgactttatcgacctgatgaccttcgggcgtgagccagatttggtgtgcgcccaaatcgttttgatgcgcgagggcatagctcaaatcgggcgcgcacaatacgccgtcgagccagtagtgcaatgccgtctgaaacggcggctgcgcttggatttggttcagcaatgcctgtacgggcagggattttttgatgccgcctgagaggtcgtctgaaagccatgccgcctgcccctgcggcaaaggctcgggcggcacgaaaccttgcggcacggcgcgggcgtgcaggcgttcggcaagaatgacggacaaggcgtgctgccactcggcgggcgcggtgatgtgttgccacagttgcggcgcggcggcgtggtcggttgcctgccagaaatcggcggcttcctgctgttgcgacaggatttgcgacaacgcctgctgctgcgcctgcaaggtgatgtgttgctgcttcaggctttggaagcggtttgaggccgtctgaaacgcctcgcgggcggcgtgtaaggcttcttcggcggcaatgatttgttcttcgtaatgctcttgctgactttgcaacaaggcggctgcttcctgcgcggcggcggtttcggcttcgtcgggcaggtttaaggcttggttttcctgtttcagacgacctttgcgctcttcgtgcttggcaatcgtttgttcggcatgggcaagctgctgctgcttcaacgccagttcgcggcggatgcggtttgcctcgtcctgctgggtttggaaggcggcgttgagcgtggcttgggcttcttccaattcgggcagacgctcctcgtgttcggcaacctgcatcgcccattccgccagctcggtttgtttttcttcgacctgcaactcgttttcttcaagctgcacgcggatttgctgctgctcttgatgaatgcgttgtaactgcgcctgcgctgcctgcttgtcgcgttcgatgcgttggtgcaggttttgctgatggcggatttgttcttccaaacgggcaatctgctcgcgcaacacgccgcgcttgttgctcaattcatgcactgcctgctgctgcgactgttcggcagtctgcaaggcgtgtacttcgtcgtttaacgcctgaacctgcgcggcggtttcgtcctgctgcgcctgcaaagattgatgctgcgcggtcgccttatcggcggcggcaagcgattgccgccattgggcgtaatcgagcaaatcctgttgctgattcagctgcgcggtcagggatttgtagcgttcggcggtttccgcttgtttttccagcttttccacctgacgcgccaactcgttctgcaaatcgcccaaacgctgcaaatgctcgcgcgtgtctttcagacgaccttccgtctccttgcggcgttccttatatttggacacgcccgccgcctcctcgatataggcgcgcaactcctccggccgcgcttcgatgatgcgcgaaatcatcccctgctcgataacggcataaccgcgcgcgcccacgcccgtacccagaaacaaatcggtaatgtcgcggcggcgcacggtctgattgttgatgaaataagtcgattcgccctgccgcgtcagctgccgcttgatgctcacctcggcatactgcccccacgccccctgcaaactgtggtcgctgttgtcaaacaccagctccaccgaagccctcggcgcaggacggcgcgtcgccgcaccgttaaaaatcacgtcctgcatactctcgccacgaagctgcttcgccgaagcctcgcccaacacccagcgcaccgcgtcaatcacattcgacttgccgcagccgttgggcccgataaccgcgacaagctgccccggcacatgaatcgtggtcgggtcggtaaaagatttgaagccggagagtttgatatgggtcaggcgcataatggtcggaaaaaataaaaaagaagcgtattttaacggaaatcccgccgcaccaccccatatcttgccggcaaaaccttaccgcatcccgcaccctcgatgccgtctgaagccttcagacggcatttttaacgcgcccgaaccccggttccgccaatgcccgatgcttggcgcggcatttgccgtattgccccgccgccgggcgcgttataatccgccccgacatccgcccgattggaaacctgcctatgaaacccgcctatttcatttccgacctgcatttgagcgaaaagcagcccgaactgaccgcgctgctgctgcgttttttacgttcttccgccgccgggcaggcgcgggcgatttacattttgggcgatttgtttgatttttgggtgggcgatgacgaagtttccgagttgaatacttcggttgcgcgtgaaatcaggaaattgtccgacaaaggcgttgccgtgttcttcgtcaggggcaaccgcgacttcctgatcggtcaggatttttgccggcaggcgggcatgacgctgctgccggattactcggttttggacttgttcggctgcaaaaccctcatctgccacggcgacactctgtgtacagatgacagggcataccaacgtttccgcaaaatcgtgcatcggaagcggctgcaaaaactgttcctaatgctgcccctgaagtggcgcacgcgccttgccaccaaaatcaggcgtgtcagcaaaatggaaaaacaggtcaagcccgccgatattatggatgtcaatgccgcctttaccgcgcggcaggtacgcgccttcggtgcggaaaggctgatacacggacacacccaccgcgagcatatccatcacgaaaacggctttacccgcatcgttttgggcgactggcataacgactatgcttcaatcctccgcgtggacggggacggcgcggtattcgtgccgctggaaaaatactgaaaatgccgtctgaagcctttcgggcggctttttttacacgcccctttcccacactccctccgccgcatcatcactatccttaacccgcattaatagccattatcgataaaatgcttgaccgattacataagattacgtaaagtgtgcaaacgcataacaattggtcttaccaatttatcttttaaccaaaatatcgggtgtacgggatttgaacgtctttccaaacctcgacgcgccttatgatgcaaatgcctaaaaaggattcgttatggcacttttcctcagcatattccccatcgtcctgctgatttggctgatggtgaaaaaaaacagtatgccctcctacgtcgcgctgccgattaccgcagtgctgatttacgccatcaaacttttctacttcgacgatgcgggcatgctgctcaacgccaccgccgcttccggcctcgtcaaaacgctcacgccgattaccgtgattttcggcgcgattatgttcaaccgtatgatggaaaccacgggctgcatcgatgtcatccgcaaatggctggcgaccatcagcccgaaccccgtagcgcaactgatgattatcggctgggcttttgcctttatgattgaaggcgcatccggcttcggtacgcctgccgcgattgccgcgccgattctgatgagcttgggcttcaacccgttgaaagtggcgattttcactttggtgatgaactccgtccccgtctctttcggcgcggtcggtacgccgacctggttcggtttcgcaccgctgaacctgagtgccgaagacatcctcgccatcggcaggcagaccggcgtaatgcacttcttcgcaggtttcgtcatccccgtcatcggcttgggcttcatcgtaccttggtctgaaatccgcaaaaacttgggcttcgtcgccattgccgtcttctcctgcaccattccttatgtcgcattggcgatggtcaacgaagaattcccgtcgctcgtcgccggcgcgatcggcctgatggtgtccgtattcgccgccaaccaaggctggggcttgagcaaagaccacgccaaagacccgaatgccgaaaaagtgccgttcgcccaagtcgccaaagcactcgcccctttgggtatgctgatcggcatgctggtggttacgcgcatcaaacagctcggcatcaaaggcattttgaccagcaaagaagaatggttcagcttccaactgccgtttgatttgtccaaaatcaccgtcagcgactccctgacgattaccttcggcaatattttcggacaagatgtcagcgcgtcttaccaaacgctgtacgtcccggcttggattccgtttgtgctgaccgtttggatttgcatcctgctgtataaaaccaaattcaaagatgcctggacgatttattccgtaaccttcaatcaaaccaaaaaaccgctgcttgccctgatgggcgcgctgattatggttcagctgatgctggtcggcggcgacaattcgatggtgaaaatcatcggtaaggaatttgccgcaatggcgggcgaacactgggtttatttctcgccgtatctgggcgcgatcggtgcgttcttctccggttccaacaccgtgtccaacctgaccttcggcccgattcagcagcaaatcgccttggataccggcctgtccgttaccctgattctggcgttgcagtccgtcggcggcgcgatgggcaatatggtgtgcctcaacaacatcatcgccgtatgtaccgtattggatgtgaaaaattccgaaggtgcgattatcaagaaaaccgttatcccgatggcgatttacggcgtgattgccgtcgtcgcggcaatgattttcttcctctaggcgaaacgccaccatccatagcggcagcacgcggggaacggaaaccgccgttcaccgtctgggcggcgcgtcgggcagaatcccggtgccggaacaagcccgccccgccaaacaaatgccgtctgaaaccgaaaaaggcttcagacggcatttttccgccgtttgcgttcaggcgtaatgatgatgcggcatcttgccgtcaaggcggtagcgcgtgccgcaatacgggcaggcaacgctgcccgattctccttcgcacaaaggcaaaaacactctcggatgcccgttccactgctcgttgccgggtcccgagcaatacagcggcagattttccggcaacacggaaatttcctgcggattcagattgtccatttgattttcctttgcgtggttggcgtgcgcctattttacgccatcggcaggctaaaggatattttcggcgcaaagccgcaatccgctataatccccacttttcagacggcataccatgactgcgcttacccttccggaagacatccgccaacaagagccatccgccctgctctataccctcgtttccgcctacctcgaacacaccgcccaaaccggcgacgaatccctctcctgcctgtccgacgaccagcacacgctgaccgcattctgctacctcgacagccaagtcgaagaaggcggcttcgtgcaactcatcgcatccggttacggcgaatatattttccgcaacccgcttgccgacagcctgcgccgctggaaaatcaaagccgtgccgaaagtcttggacaaagccaaagccctctacgaacaacacggcaaaaccatcgaaacgctcgccgacggaggcgcagacatcccttccctgcgcaaacagttccccgaatttgaagaatgggacggcgcatactacgaagccgccgaacaagacctgcccctgcttgcagaacacatacagtcaaactgggaaaccttcgcccatatcgggcaggcgtgattgcgtctgtttccagcccgtgtaaaacagcgtaaaatcggcaaacccgaatgaccttccgtccccatcaaggagcaagctatgttcttcaagcacatcgaagccgcccccgccgatccgattctcggtttgggcgaagcgttcaaagccgaaacccgccccgaaaaagtcaacctcggcatcggcgtttataaagacgcatccggcgcgacacccctcgtcaaagccgtcaaagaagccgaaaaacgcctgttggaaagcgaaaccaccaaaaactacctcaccatcgacggcgttgccgactacaacgcgcaaacccaaatcctgctgttcggcaaagaccacgaaatcatcgccagccgtcgcgccaaaacagcgcaaagcctcggcggtacgggcgcattgcgtattgcggccgagtttgccaaacgccagttgaacgcgcaaaccatctggatttccaatccgacttggcccaaccacaacgccatcgccaaagcggtcggtatccaagacaaaccttatcgttactatgatgccgccaaacacggtttggattgggacggcatgattgaggacttgagccaagcgcaaaaaggcgacatcgtcctgctgcacggctgctgccacaatcctaccggcatcgaccctacgcccgaacaatgggaaactttggcaaaactttctgccgaaaaaggctggttgccgctgtttgactttgcctaccaaggcttcggcaatggtttggaagaagatgcctacggcttgcgcgtgttcttgaaacacaatacagaattgctgattgccagctcttattccaaaaacttcggtatgtacaacgagcgcgtcggcgcgttcactttggtggccgaagatgaagaaacagcagcccgcgcccacagccaagtcaaaaccatcatccgtaccttgtattccaacccggcttcacacggtgcgaacaccattgcgctggtgttgaaaaatgatgatttgaaagcacaatggattgccgaactcgatgaaatgcgcggccgcatcaaagccatgcgccaaaaatttgtcgggttgctcaaagccaaaggtgcaagccaaaactttgatttcattatcaaacaaaacggtatgttctctttcagcggcttgactcccgaacaagtcgaccgcctgaaaaacgagtttgccatttatgccgtccgctccggccgcatcaacgtcgccggcattaccgacaacaacatcgattatctgtgcgaaagcatcgtgaaagtactgtaaaaagcacagccatatgaaaatgccgtccgaaccttaaccagttcagacggcatctgttttttgttaaaaaacaataaaccataacaatttcaaacaagctaaaaacatctataaaatcaaccaaatatgatgaactcaaataaaaaatacgaatatcatcattctcaaattcaaaatttgaacgccacagtattatccgaagccacaaaaacctttccgccgtcattcccgcgcaggcgggaatccgggaatccaatgctgcaagaattgattagaaacaactgaaaccgagcaaactggattcccgcctgcgcgggaatgacgaaataaggcgagtgaaactgatgaaacaaattgattaaaaacaataacttatattattttatttaaattttcgataaaatcaattttccgtattcaatactgctccaatcaattcccgcgcaccgtcgtccgccaatttcttagcgacagcgcgtccgagcgcgtcggcatattcggcaggggcttgcgcgtccgcccgcaacacaaccgaaccgtcggggtgtccgaccaagccgcgcaaggtcagcaagccgttttcttccgtgcaatatgcggccaaaggcacttggcagcttccgcccaaagcgcgtgcgagggcgcgttcggcggtaacgcaggcattggtaacaccgtggttcaagggtttcaaaacttcatacaaatcttcgcggtgcgcggcaatttcgatacccaatgcgccttgtccggcggcaggcaggctgtcggattccgacaaaatcatgcggatgcgtccgtccaatttcagacgctgcaaaccggcggcagccaagataattgcgtcgtattcgccgttatcgagtttggacaaacgggtttgcacattgccgcgcaaaggtttgataagcaaatgcggatagcgcgcacgcaactgggcttcgcggcgcaggctggatgtgccgacaaccgcgccttcgggcatttcttccaaacgcgtgtattggttggacacaaacgcgtcaaacggattggcgcgttcgccgatggcggcaagcgcgaaaccttcaggcaaatccatcggcacgtccttaatcgaatgcaccgccaaatcggcgcgcccgtcatataaagcctgttccaactctttgacaaacaagcctttaccgccgacttttgacaaagttttgtccaaaatctgatcgccgcgcgtggtcatgcccaaaatctcgacttcgcaatcgggatacagagccttcagacggccttggatatgctttgcctgccacatagcaagcaggctttcgcggctggcgatgacgagttttttcgggttcatgttcaatgcgttcaaagaatggaaacggcgtgaagtctatcatattttgaacgtttcttcagacggcaccgtcaggtctatgttatatttacacccacaaaacacgaaacccgccacaatgaaacgcaccaaaaaataccctttcttaacgttgcagcggcaacgtttccatttgaactttgaaaacgcctcttccgccgccggcatcccagccgaacgcgatttctaccgctgggcgtggtctgccttgaaaaatgaataccgccgcgccgacatcagcctgattcttctggacgaagaagaagcccgagcctacaaccgcgactaccgcggcaaagattacgccaccaatgtattgagtttcgcgctcaacgaaggcgaaatcctgccctgccaagtttcggaaaaactgtacggcgatttgattatctgcccgcaagtggttttgaaagaagccgccgaacaaggcaaaacacccgagcagcattttgcccacctgaccatacacggtactttacacctgatgggctacgaccacatcgaagacgacgaagccgaaataatggaagccgaagaaatccgcctgatgcgggcggcaggcttccccaacccctaccaagaggactgacattaaaatggacggcgcacaaccgaaaacgaatttttttgaacgcctgattgcccgactcgcccgcgaacccgattccgccgaagacgtattaaacctgcttcggcaggcgcacgagcaggaagtttttgatgcggatacgcttttaagattggaaaaagtcctcgatttttccgatttggaagtgcgcgacgcgatgattacgcgcagccgtatgaacgttttaaaagaaaacgacagcatcgagcgcatcaccgcctacgttatcgataccgcccattcgcgcttccccgtcatcggcgaagacaaagacgaagttttgggcattttgcacgccaaagacctgctcaaatatatgtttaaccccgagcagttccacctcaaatccattctccgccccgccgtcttcgtccccgaaggcaaatcgctgaccgcccttttaaaagagttccgcgaacagcgcaaccatatggcgattgtcatcgacgaatacggcggcacatccggcttggtcacctttgaagacatcatcgagcaaatcgtcggcgaaatcgaagacgagtttgacgaagacgatagcgccgacaatatccatgccgtttcttccgaacgctggcgcatccatgcagctaccgaaatcgaagacatcaacaccttcttcggcacggaatacagcagcgaagaagccgacaccattggcggcctggtcattcaagagttgggacatctgcccgtgcgcggcgaaaaagtccttatcggcggtttgcagttcaccgtcgcacgcgccgacaaccgccgcctgcatacgctgatggcgacccgcgtgaagtaagcaccgccgtttctgcacagtttaggatgacggtacgggcgttttctgtttcaatccgccccatccgccaaacataaaaatgccgtctgaaaccgttgcaagtttcagacggcatttcgcttatccgcttattttttgctcaaagtcagccccgtccaaccgaataacagggtcaaagccaaactcaaatagcagaaaaaggcatacggcagatattcccaaaccggcacgcccagcgcgtggctgatgaacacgccgcatacgctccacggtacgagcgggttaatcaccgtccccgcatcttccagcgtccgcgacagattgcgcgaatgcagaccgagcttatcgtaaacgggtttgaacgtttcacccgacaacaaaatactcaaatattgctcgccgatcaggaaattaaccccgaccgaagtcatggcaacgctgaacgtcgcgcgtccggcattcgtcaagaaggtacggatggcctccaacagggaaggaatcacaccgagcgcaaacaacagtccgcccaaactcatcccgagaatcacgatggtttgcgtgaaaaacatactttccaaaccgccgcgcgaaatcagtttgacaacatctttaaacgcttcgccttcgagtttgtagccgccgtaaaaccacgcaccgagctgacgcagatcgggcgtgctgtgcagatacgttacagcaacggcaaccatgacggtaaagagcatggcgacgacggcgttgatgcgcatcaatgccaaaatgaccaacagcgcaaacggaatcagcgaatagccgtgcaccaatcccgtggcttcaagctggctgcggaaggattcgacgctgttcaaatcctgcgcggcgacattcggcaaaagccaaagcatcagtgccgcactaatgagccacgcggggatggtggtgtacatcatatttttgatgtgctcaaacaagtcgatgccgacgatggacgcggaaatacccgtcgtatccgaaagcggggacattttgtcgccaaaaaatgcgcccgaaacaatcgcgcccgccgtcatcgccatatcggcctgaaacgccgccgccatccccataaaggcaacgccgacagtggcgcaggtggtcaggctgctgccgatggacacgccgatgacggaacacagcgcgaaggaggaaaaataaaaataagtcggggaaatcagtccgaaaccgtaatacatcagcgtcggaatcgcgccgctcatcatcagcgcgctgaccatcagcccgatgaagaaaaacaggtaaatcgcgcccataccctgattcaacgcgcctatcatgccctgctgcatatcgttgtatttcaaaccgcgcgccaagccgtacaaaatcagcacgacgatggcggcaataatggacatatgcggcaaccactccaatgaaatgatggtatagcccatcgcggcaatcagagcgacgacgacggcaagtgcctcaccgcgcggcatatcgagtaaggatttgaaagcgaacatgattctttgcccgatttgatataaagttaacggattctaacacaccataccgaatccgcccgacgttttcagacggcattttagcgttttacaaaagccggacagaaacaaaacggcaattttctcaatttaaattaatttttttgaaatataattttttatttttttgtttgttgacatataagacttttatggattgaagtattaaaacctcggcacacacgccgcaaacaccggtacgcaaaaatgccgtctgaaagatgttcagacgacatttctcaagaaaaagattatttgtccgccctatatccgtacaccgcaaaaaacacgatatacagataacagatgacggaaacgacaaacgaagacatcagggtgtaagtatctgccacccagccctgcacgacaggaacgaccgcaccgccgacaatcgcggtacacagtacaccggaagccgcgttggtaaattttcccaatcctttggttgccaaagagaaaatcgtcggaaacataatcgagttgaaaaaaccgatggcaagcagcgaccacatcgccacatccgcattgccgctacccgtcgccatcgcgacggcaagcagtacgaccgcagccgatgcgttaaacgccaaataacggttgggcgcgaatttcgccatcaccgccgaaccgaggaaacgtccgaccatcgcgccgccccaatagaacgacaggtaatgcgcggcagaagcatgatccagccctttcagataacccaatacgttgaccatcaacgaaccgatagacacctccgcgccgacatagcagaaaatgcctgccgtaccgaacacgagatgtttgtattgccatacgctggttttgccgtcgtggttgtgcgcgctttcctcggcggcaattttgcgcgcgtcgggcagccggatcattttcacgaaaacggcaaggataatcagcagccccgccagtcccaaatagggaatctgtacggaagaaatctgttccgccttgctgacggtttgggttgcgtccgccagaatcaggaacgcgccgatttgcggcgcaatggtcgtacccaaagcgttaaacgcctgaaccagcgtcagtgttgccgattccttgccgggtttcgccagcagggtaacataaggattaccggcgacctgaagcagcgttacgccggaagccaaaataaacaacgcgcccaaaaataccgcgtaagaatggctgcccgcagcaggataaaacagcaggcatccgaccgccgtcagcagaaagccgccgataacgccgtttttgtagccgactttgccgacaaaagcccccatcgggatggacatcaccgcataggcggtaaagaaacagaattggatcagcatcgcctgaacgtaagacaggtcgaaaatttctttcaaatgagggataaggatgtcgttcatgcaggtaataaaacccatcatgaagaacagcgtggtcaagacgaccaatggggacgtatgattgttttgtgattgcgcagacatgatttgcctttcgtggtgtcggaatattacccgtttcaagaaaatagaaattgacatttcttaacggcaatgcaaatcatactgatatttgaacattttgcaaactttatcggatgcaggcaatgcgccgatctgaaattcaagcagcagaaattaatattttacagttgcttgcatagattttaatagattttaaaaaatccggcggacttgcaaaaaccgttcccaataaaatgaaaatccgccgccgtatccggaaaattcggaaatgccgcatcgtggcatcaaaaccggagcggaaagaatgtcgtatgcccgacaaaaaaggggcatacggctgtgccgtattttttgcaccgtcctccgcccttcggcgggggcgtgaaaatagagtggattaacaaaaatcaggacaaggcgacgaagccgcagacagtacaaatagtacggaaccgattcactcggtgcttcagcaccttagagaatcgttctctttgagctaaggcgaggcaacgccgtactggtttttgttaatccactataccgtacaatccgtcgccgattgttacctgtttgagactgtttgcaatgataccctcctacacctacgccgccctcgccttttccgcattcacttccgccaccctcctgcccggcacatccgaagccgcctttgccctgttcgtccaccgctttcccraacacgcatacggcgcgttgctgtgcgccggccttgccaacggattgggcagtatggtttcctattggatggggcgtttgctgccctcccgaaaaatgccgtctgaaaaaacactgaatctgatgcggcgtttcggtatttggctgcttgcgtttacctggctgcccgtcgtcggcgacgcactgccgcttgccgccggctggctgcggttgaatccgtggacaagcgggctgatgctggttatcggcaaaacggcgcgttacgccttcattctgtggggaatgcaatattacgccgcctgaaccatacgttataatgccgaacacacaaacccaccgtataaaaaaatgaacagacacatccgccaagaaatcttcgaacgcttccgcgccgccaacccccatccgaccaccgagctgaatttcaactcccctttcgagcttttaattgccgttctgctttcagcgcaggcgaccgatgtcggcgtaaacaaggcgacggcgaagctgtttcccgttgccgatacgccgcaggcgatgctggatttgggtttggacggcgtgatggaatacacgaaaaccatcgggctgtataaaaccaaatccaaacacattatgcaaacctgccgcatcctgctggaaaaatacaacggcgaagtgccggaagaccgcgaggctttggaatcattgccgggtgtggggcgcaaaacggcaaacgtcgtattgaacacggcgttcggccatcccgtcatggcggtcgatacgcatattttccgcgtatccaaccgaaccaaaatcgcccccgggaaagatgtgcgcgaagtcgaagacaaactgatgcgcttcattcctaaagaatttctgatggacgcgcaccwctggctgattttgcacggacgctacacctgcaaggcactcaaaccgcaatgccaaacctgcatcatcaacgatttgtgcgaatatcccgccaaagcctgaccgccgccgcccttcaaaatgaaacgcttgaaaattcggacggacgttgtagaattttaacctatgccgtctgaagccgacaaaatgcgcttcagacgg

SEQ ID NO: 37806 - DNA, 10577 bp, Neisseria meningitidis
gcaggtcgtatctagaggatccccggcaatttccctttatctgctttgaaaaacggtgcataatcccgagcaaaaccgcaatcaggagcaattatgcaaaactatctgacccccaatttcgcctttgccccgatgattcccgaacgcgcttcaggcagccgcgtttgggatacgaaagggcgtgaatatattgatttttcaggcggtatcgccgtcaatgcgctgggacactgccaccctgcccttgtcgatgctttaaacgcgcagatgcacaagctgtggcacatttccaatatctatacgacgcgtccagcgcaggaattggcgcaaaaattggttgcaaacagttttgccgacaaggtttttttctgcaactcgggctcggaagcgaatgaggcggcgttgaagctggcgaggaaatacgcccgcgaccgtttcggcggaggaaaaagcgaaatcgtcgcctgtatcaacagttttcacggacgcacgctgtttaccgtgtccgtcggcggtcagccgaaatacagcaaggattatgcacccctgccgcaaggcattacgcacgttccgttcaacgatattgccgcgctggaagctgccgtcggcgaacagacctgcgcggtcatcatcgagccgatacagggcgaaagcggcatcctgcccgccactgcggaatatttgcaaaccgcgcgccgtctgtgcgaccggcacaatgcgttgttgattttggacgaagttcaaaccgggatggggcatacgggcaggctgtttgcctatgaacattacggcattgttcccgatattttgagttcggcaaaagccttgggctgcggctttccgatcggcgcgatgctggcgacagaaaagattgccgccgccttccaaccgggcacgcacggctcgactttcggcggcaacccgatggcgtgtgcggtcggcagccgcgcattcgacatcatcaatacgcccgaaactttaaaccatgtccgtgaacaggggcagaaacttcagacggcattgctggatttgtgcaggaaaacgggcttgttctcacaagttcgcgggatggggctgctactcggctgcgtgttggacgaagcctatcgcggacgcgcatccgaaatcaccgccgccgccttgaaacacggcgtgatgattttggttgcgggtgcggacgtattgcgtttcgcgccttcgctactgttgaacgatgaggatatggcggaaggtttgcgacgtttggaacacgcgctgacggaatttgccgcgacatcagacaatccgtaaaactcaaatgccgtctgaaggcgggaaggcttcagacggcatcagaaacaaaaaaccgcttcagaaacgtggttcaacgttccgaagcggttttgtttgccatcaggactcgaacaccaattccggttccctgccctcttcgatgactgccttaccgaccaccacttttttcaagcctttcaaatcaggcaggcggtacatcgtatcgagcaggcagcgttcgacgatggacctcaggccgcgcgcgccggttttgcgttccattgcctgacgcgcgatggaacgcaatgcgccttcttcaaactccagttcgacattttccataccgaacaacgcctgatactgcttgaccaaagcatttttcggctcggtcaaaatattaatcagcgcgtcttcgtccaattcttctaaagttgcaatcacaggcaaacgtccgattaattctggaatcagaccgaatttaatcaagtcttccggttcgacgatgccgaacagcttggtaatgtcggcattttcgtccttgctgtgaacggacgcaccgaaaccgataccgcctttttcagtacgctggcggatgactttttccaagcctgcaaacgcgccgccgcagataaacaggatgttggtggtatcgacgttgataaattcctgattcggatgcttgcggccgccttggggcggaacgctggccactgtaccttcaatcagtttcaacaaggcttgttgcacaccttcgccggatacgtcgcgggtaatcgacgggttgtcgcttttgcgtgaaattttatcgatttcgtcgatatagacaatgccgcgctgggctttttcgacatcgaaatcacatttgcccaaaagcttggtaatgatttgctcgacgtcttcgccgacataacctgcttcagtcaaagttgtggcatccgccatcacgaacggcacatccagtttgcgcgccaaagattgcgccagcagggttttacccgatccggtcgggccgataagcaggatgttggatttcgacaattcgacattagctcctgctttaggatggcgcaggcgtttgtaatggttgtacaccgacaccgccaaggctttcttggcttgttcctgaccgataacgtggtcgttgaggttggcgacgatttcggcgggcgtgggcagcttgccggattcttccggctcccctccggcactttccgaaggcgtgccgtcatttccgtcttcatgcaatatttcaatacagtttgagacgcattcgtcacagataaaggcgttttcgccctcaattaaatgtttgacgtgtgatttggattttccgcaaaaggaacaagtacggttttcgttggacatggctttctttacaatgtatgcgttacagaaaacggcacgtgccgttcgggttgccaagtataataactatatccgttcttatcaatgtattaccttaaaatcccgccgattaggctataatacgccctttcgcaaccgccccggcggcaaaaatgccgtctgaaaccaaatctgaaatctgaggatattcatgagaaaaccccaacgcggctatgcccgccaagaccgtgtcaaagaacaaattatgcgcgagcttgccgaactcgtccgtaccggactgaaagacccgcgcgccggcttcattaccgtcaacgaagtcgaagttacccgcgattacagccacgccaccgtgttctacaccattttaaaccaagacgcgcgcgaaattacggaagaagtgctggaacacgcgcgcggacacctccgcagcgaattggccaaacgcatcaagctgttcaaaacgcccgaactgcatttcaaatacgacgaatctttggaacgcggtttgaacctgtccgcccttatcgaccaagtagcggcggaaaaaccggttgaagactgacggatatgcccatgccgtccgaacatcgaaccatgaatacaggcaaaccccaaaaacgtgccgtcaacggtgttttgctcttggacaaacccgaaggcctttccagcaacaccgcgctgcaaaaagcgcggcgtttgtttcatgccgaaaaagccggacataccggcgtgctcgaccctttggcaaccggacttttgcccgtctgcttcggtgaagcgaccaagttcgcccaatacctgctggatgccgacaaagcctacaccgccacgctgaaactcggcgaagccagcagcacgggtgatgccgaaggcgaaatcattgccaccgcccgcgccgatatttccttagccgaatttcagacggcctgccaagcactgacaggcaacatccgccaagtgccgccaatgttttccgcgctcaagcacgaaggcaaaccgctgtacgaatacgcccgcaaaggcatcgtcatcgaacgcaaagcgcgctacattaccgtttacgccatcgatattgccgaatttgacgcgcccaaagccgtcatcgacgtacgttgcagcaaaggcacctacatccgcaccctcagcgaagacatcgccaaacacatcggcacgttcgcccacctgaccgccctgcgccgcactgaaaccgccggctttaccatcgcccaaagccacacgcttgaggccttggcaaatttgaacgaaacagaacgcgacagcttgctgctaccctgcgacgtattggtttcacactttccccaaaccgttttaaacgattatgccgtccatatgctccactgcggacaacgtccgcgtttcgaagaagacctgccttccgacacgccggtacgcgtttacacggaaaacggccgctttgtcggtctggcggaatatcaaaaagaaatatgccgtctgaaagccttgcgcctgatgaacacggcggcatccgccgcctgaacggcggttaaaaatacaggctgtgcttgaataatgtgttgatatttccgcaaaatcccgacacactcggacacccgccccgcttatcgcaactttgcgaacgcccccggaaacagcaaagacatcaaataattgattttattagaatctatttgcaaagccatttgccgttacacaagaatggcacattaaaataactgatgaggatttataacgatgaagacagacattcaaaccgaattaacccaagccctactaccacacgaaaaagtatgggcgaacgaagaaaaaaccattttagccaaaaacatcctgttggatttggtggaaaaaaccgacccgaccattatcggtttgttattgagtaatgatgagttaaaacgccatttctttgtggaagtgaatggtgtgctggtgtttaaattgcaggatttccgttttttcttggacaaacacagcgtcaataattcctacacaaaatacgccaaccgcattggtttgacggacagcaaccgctttttgaaagacagcagtgatattgtgttggattttccgtttaaagattgtgtgttaaatggcggacaaagcaccgaggaaggcgaagaaatttattttaaacgcaataacagccagccagccagccagccagccagccagccagccagccagccagccagccagccagccagccagccagccagccagccaattatacactaaattaacccgaaaaagacaagaaatcttttttaatcaaacccttgcttttgatgaaattgatcggctttttgacgcaaaagcattctcaaaattctctcgctataccgcagacggcaaacaagccgttggcgaaatcaaacgacattcagacggcacacccgccgaaaatctcattatcaaaggcaataatctgattgccctgcattcgcttgccaagcagtttaaaggcaaagtgaagctgatttatattgacccgccatataacacgggtaatgacggttttaaatacaacgacaaatttaatcattccacttggctgacttttatgaaaaaccgtctagaaatcgccaaagagctgcttatgaaagacggttcgatttttgtgtcaattgacgacaacgaacaggcatatttgaaaattttaatggatgaagttttcggaaatgaaaatttcatctgcaattttatttgggaaaaaaagacaggtgcgtccgatgccaaacagatagcgactattacagagtttgtcttatgttactcaaagaactttaaaacagttaaattaaataaaaacacgttttcttatgatacagagagatacaaattaagtgataagtttgaacaggaaagaggcaaatattatatcgacaatttagatagagggggattgcagtatagtgacagtttgaattttgcaatccaatgtccagatggcacttttacgtatccgaatggcaggactgaatttgtcaatgatggctggatatggaaatggagtaaaaataaaattgattgggcaataacaaacggttttttggagtttagaaaatcaaagtctaaaaaatctggatggagtgtatgttataaaaactatatgttggttgataacgaaaacaagccgatagaacgttctgctccctataagaacttaatacaggatatcttaaatacacatgcgacagatgaattgaaaaaactgttcggcagcaaagtttttactactccaaaacctgagagcttattgcagtatcttattcaaattgccacatccgaatccgacatcgtcttagactaccatcttggtagtggcacaaccgccgccgttgcccacaaaatgaaccgccaatatatcggtattgaacaaatggattatattgaaacgcttgctgttgaacgcttgaaaaaagtgattgatggcgagcaaggcggtatttccaaagccgtgaattggcaaggtggtggcgagtttgtttatgccgaacttgccccatttaacgaaaccgcaaaacaacaaattttggcttgcgaagattcagacggcatcaaaacgctgtttgaaggtttatgcgaacgctatttcttgaaatacaacgtcagcgtaaatgaatttagtcaaatcattcaagagcctgaatttcaatctttgccattagacgaacaaaaacaaatggtgcttgaaatgttggatttaaatcaaatgtatgtttcattatccgaaatggatgacgaacaatttgcagattgcctgaacgatgatgataaagccttaagccgtgcattctatcaatcagtaaaaaatcaagcggagaaaaaagatggcgaataataaaacgttgtttgaagtgattgaaaatgaacgtaaagcggttaaaaaatacaagcctgaattacttgaaatgccagaatttacgtccaaaaacttaaaatatgatttttttgaatggcaaaaatctgcccttgaaaactttttgatttttgaccgcacttcaaagctagacgatttccctgatttaaaaaataagccaacgcatttgctgttcaatatggcaacaggtgctggcaaaacgatgatgatggcggcgttgattttgtattattttgaaaaaggttatcggcattttctgttttttgtgaatcaaaacaatatcgtggataaaacggaaaataattttaccgatccgacgcacgcaaaatttttatttaccgagaagattttgcagggcgatacggtaattcctattcgcaaagtggagacatttagcccacattcagacggcattgaaattaaatttaccagcattcaaaagctgtataacgatattcgcacccggcgggaaaatcaaaccacattggcggatttgcacaaattgaaccttgtgatgctgggtgatgaagcgcaccatttaaacgcgcaaaccaaaggcaaaaaacaaggcgaattagatttagaaaaggaaatgaacgaccgcaccagcaatgccgaaattgaacgtaaaggctgggagcatatggttttggaattgttactcaataaaaatggcaatcatagccaaaatgtgctgttggaatttaccgccacgctgcctgaaaatgccgatgtacaacaaaaatacgctgataaaatcatcacaaaatttggcttaaaagaatttttgcaaaaaggttataccaaagaaatcaatttggtatccagtacgctgggtaagaaagagcgagtgttacacgctttattgtttgcttggtatcgacatcgaattgcgttgaaatatggcattgccaatttcaagcctgtgatgttgtttagaagtaagacgattgatgaatcaaaagcggattatctggcatttttaaattgggcagaaaatgtgcaggcggttgatttttcgtttttaactacattttcaacaagcttgaacgatagcgatagcgataacgccaacgaacaaggcaaaacccgcactgaacaagccctaaaatttatgcaggaaaaaggcgttgagtttgcacatttggcagattgggtaaaacaaaattatcaaaaacacaatgtgattattaccaactccgaaaccaacaaaaccaaaaccgaaaaaaccgacagcgaaacagaaaaattgctgaataatttggaagcggctgataatccgattcgtgccatttttacggtggacagattaaccgaaggttgggacgttctgaatttgtttgatattgtgcgtttgtatgaagggcaaaacggcggcggttcaaataaaaaatcaggcaaaacggctgccgctactgtatcggaaaagcagttgattggtcgcggcgtgcgttattttccatttgcgtttgaaggtaaacagccgaataaacgcaaatttgacaacgatatgcaacacgaattgcgtattttggaagaattgttttattacacgcacgatgagcaatctcgctatattacagaactgaaaaacgagttacgaaaagacggttatttgcctgaaaaagacgatgataaggtattggcaacatttaaactcaaatctgaatttgccgataatcaggattttagagagttgttaatttgggcaaataaaaaaatccccaatcccaatgccagagccaataatgcagacagcytgaaagccaatccgcaaacgcttccattccaagttcacggcaatcaactgttgcaggaaacgcaatttacagccgatgaaaatgatgaaatagcccgacaaatcgacacacaaaataattttactcaaatcataaaaatgagtgaaatggaacggcacattttcaataaatccctgcatatcaaaggaaaaaatggtcaatctttattccattttgaccgcttgcaaagcaaactcaacatttacaatcgcaatgaattgcaaaataacttgttaaaagattgacaaattgaatttttgggattagggcaagacaaacagatcagcccagatgacaaacttgcaggctgcctaaaaatcttggaaatggttgaaaaacatttgaatgaaagtgatatgccatttatcggtacaaaagaatttacgcctaaaaaattgtgggaaatttttggcacaccaaaacaaaaatgggtcaaaaaagatgatataaaaactgccattgccacgcaaaatgattggtatgtgatggataattttgctggaacgagtttggaagaagcgttaattcaatttatttcagagcatttgggcgatttgaagtctaaatatgatgttcatttaatccgtaatgaagaagtgtttaaattgaataacttttccgatggtgaaggatttatgccggactttattttattgctgaaaaataaacaaaaatcttcttccaatggtgtggatgactttttgcattaccaaattttcattgaaccaaaaggtgagcatttggtggaaaatgattcgtggaaagacgcttttttaaaggcaattacagcggaatacgggacggataagattctgcaaaaagatacaccgcattatcgtttgatcggtttgccgttttttactgacaatcaggaaaatgaacaatttacaaagtcattccctttaggggcggcatcgcttgaaaaatagagtggtgcattgcaggcaaccccgtttgacaaaacttcctttacaaaagggcgttttgtcagatatttaatcaacacattattaaaatacagccaaattttaatgccgtccgaaccctgtgttcagacggcatcgtatttttcagtatctaaaccgtttccctgccccaatctttgcctctcaaaatcgaagcatcgacatcttgaatatcgcggtgtcccgtaaacgccatagatatatccatttctttatacaggatttccagcgcacgggttacgccttcttctccatacgcgcccaagccatacaggaacgcccgacctatcattgtacctttcgcgcccaaagcccacgccttcaaaatatcctgaccgctgcggatgccgctgtccatccaaacttcgatgtcgctgcccactgcgctgacgatgtcgggcaaggctttgatggcagacacggtatcgtcgagctgtcgaccgccgtggttggaaacaatcaatgcgtccgcgccgcttttcgctgctttttccgcgtcttcaggttccataatgcctttgataatcagcttgccgccccacaaatctttaatgcgcgccacatcgtcccagctcaggcgcgggtcgaattgttcggaagtccatgaagacagcgaagacaaatcgccgacgttcttcgcgtgtccgacgatattgcggaacgtgcggcgttccgtgttcagcattttcatacaccattcgggcttggtcgccagattgattaaattggcgatggtcggtttcggcggcgcggacaggccgtttttgatgtctttgtggcgttgccccaaaacctgcaaatcagcggtcaataccaatgccgaacatttggcatccttcgcgcgcttaatcaggttttccataaactcgcggtcgcgcatcacataaagctgaaaccaaaatggtgcggaagtgttctcggcaacgtcttcaatcgagcagatagacatcgtggacagcgtaaacggaatgccgaacttctccgccgcccgcgccgccaaaatttcaccgtcggcgtgtgccatacccgtgaaacccgtcggcgcaatcgccaccggcattttcacatcctgcccgatcattttggtttccaggcttcggccttccatattgaccaatactttttgacggaagcggatgtctttgaaatccgaagtgttttcacggtaggtagtttctgtccacgaacccgaatcgatgtaatcgtaaaacatacgcggcattttgcgcttggcaacgcggcgcaagtcttcgatgcaggtcattttgctcaaatcacgtttcatttgtcgcc

SEQ ID NO: 37807 - DNA, 44608 bp, Neisseria meningitidis
agggtgaagtggtcggggcgtgcttcgcttaaagtgatatcgaagtattcgttttgtttcagtttgtttttgtcgtaggttttaaacgtccctttttggcggtagtaacgttccatggtctgcgcgttgtgcagcagggtcgtcctgacttccgacaggcggacgcgccggatgtaggttttataggaagggtaggtgatgagcgtcaggatgccgaggatggcgacggcaatcatcagctcgagcagcgtaaagcctttttgaacgtttttcatagcaatgtgtttccatttgtttgtcggtcgacggcattataacgccgtatcggaaatggcggaatatgtaaacggattgaaattttcgggaaagcagattgtataagccatttaaaacaaatggttatttttattgtcggcagtttgccgccttggatggggcagggacttgcggtagaatccgcttccgatttatgggattgacgcatacagagaattgaaaacatggcaaaaatgatgaaatgggcggctgttgcggcggtcgcggcggcagcggtttggggcggatggtcttatctgaagcccgagccgcagctgcttatattacggaaacggtcaggcgcggcgacatcagccggacggtttctgcaacaggggagatttcgccgtccaacctggtatcggtcggcgcgcaggcatcggggcagattaagatactttatgtcaaactcgggcaacaggttaaaaagggcgatttgattgcggaaatcaattcgacctcgcagaccaatacgctcaatacggaaaaatccaagttggaaacgtatcaggcgaagctggtgtcggcacagattgcattgggcagcgcggagaagaaatataagcgtcaggcggcgttatggaaggaaaacgcgacttccaaagaggatttggaaagcgcgcaggatgcgtttgccgccgccaaagccaatgttgccgagctgaaggctttaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggttacaacagcagtacggatacggcttccaatgcggtctactattatgcccgttcgtttgtgccgaatccggacggcaaactcgccacggggatgacgacgcagaatacggttgaaatcgacggcgtgaaaaatgtgctgattattccgtcgctgaccgtgaaaaatcgcggcggcaaggcgtttgtgcgcgtgttgggtgcggacggcaaggcggcggaacgcgaaatccggaccggtatgagagacagtatgaataccgaagtaaaaagcgggttgaaagagggggacaaagtggtcatctccgaaataaccgccgccgagcaacaggaaagcggcgaacgcgccctaggcggcccgccgcgccgataaacgaatatgccgtctgaacacggaaacggtttcagacggcatttgttattgatttacggaatattatgagcttgatcgaatgtaaaaacatcaaccgctatttcggcagcggcgagaaccgcgtccatattttgaaagacatcagcctgtcgatagagaagggcgattttgtcgccatcatcgggcagtccggttcgggcaagtccacgctgatgaacatactcggctgtttggataccgccggttccggttcgtaccgaatcgacggcatcgaaactgccaaaatgcagcctgacgagctggcggcattgcgccgcgaacgcttcggtttcatcttccaacgctacaacctcttaagctcgctgaccgcaagggacaacgtcgcgctgccagccgtctatatgggcgcgggcggcaaagagcgttccgcgcgggcggacaaactcttgcaggatttgggtttggcaagcaaagagggcaacaagcccggcgaactctcgggcggacagcagcagcgcgtctccatcgcccgcgccctgatgaacggcggagaaatcatcttcgccgacgagccgaccggcgcgctcgataccgccagcggcaaaaacgtgatggaaatcatccgcaggctgcacgaagccgggcataccgtcattatggtcacgcacgaccccgacatcgccgccaatgccaaccgcgtcatcgaaatccgggacggcgaaatcatttccgacacctcgaaaaatcccgaaatccccgcaagcaatgtcgggaggattcgggaaaaagcttcgtggtcgttttattacgaccagtttgtcgaagccttcagaatgtcggtgcaagcagtattggcgcacaaaatgcgttcgcttctgacgatgctcggcatcatcatcggtatcgcgtcggtggtttccgtcgtcgcattgggcaatggttcgcagaaaaaaatccttgaagacatcagttcgatagggacgaacaccatcagcatcttcccggggcgcggcttcggcgacaggcgcagcggcaggattaaaaccctgaccatagacgacgcaaaaatcatcgccaaacaaagctacgttgcttccgccacgcccatgacttcgagcggcggcacgctgacttaccgcaacaccgacctgaccgcctcgctttacggcgtgggcgaacaatatttcgacgtgcgcggactgaagctggaaacggggcggctgtttgacgaaaacgatgtgaaagaagacgcgcaggtcgtcgtcatcgaccaaaatgtcaaagacaaactctttgcggactcggatccgttgggtaaaaccattttgttcaggaaacgccccttgaccgtcatcggcgtgatgaaaaaagacgaaaacgctttcggcaattccgacgtgctgatgctttggtcgccctatacgacggtgatgcaccaaatcacaggcgagagccacaccaactccatcaccgtcaaaatcaaagacaatgccaatacccaggttgccgaaaaagggctgaccgatctgctcaaagcgcggcacggcacggaagatttcttcatgaacaacagcgacagcatcaggcagatagtcgaaagcaccaccggtacgatgaagctgctgatttcctccatcgccctgatttcattggtagtcggcggcatcggcgtgatgaacatcatgctggtgtccgttaccgagcgcaccaaagaaatcggcatacggatggcaatcggcgcgcggcgcggcaatattttgcagcagtttttgattgaggcggtgttaatctgcgtcatcggcggtttggtcggcgtgggtttgtccgccgccgtcagcctcgtgttcaatcattttgtaaccgacttcccgatggacatttccgccatgtccgtcatcggcgcggtcgcctgttcgaccggaatcggcatcgcgttcggctttatgcctgccaataaagcagccaaactcaatccgatagacgcattggcacaggattgaggttggacaaagatgccgtctgaagctgcaggaccggtcattttggagcagaaacttattggataaaaacggtttcttagattctacgttccagattcccacttgcgtgggaatgacggcggcgggggttcgatgattgcacacaacgctcgagtcccgtcattcccgtaaagacgggaattcggttcgttcggctttgcttgtttcggataaatcacggtaactcaatattccagattcccgcccgcgtgggaacggcggcggggcttcgtattgttcaatttattattttcaatcattcaatgggttaggatgtgtttgttggcttgctaactttcagggcggattggttttcaggcggcatttcccgcaaaaaaggcttggaattttccaagccttttttgcggatggattattgatttttgcggatgatttcctccagttggggcatcgggctgtagccgctttggctgcgcccgttggggaagacgagggtcggcgtgccgttgaagccgaattgttcgcccaaggaagtggtttccgcgacgggattgtcgcagatgctgccgccgaccgggaatttgcctttacgcatccaatccgtccacgctttggcgcggtcgggctgacaccataagatttgcgccttgcgcgcggcatcggggtgcaggccggcaatgggcatcataaagctgtaaaccgtcacgtcggtcattttttcaaactcgtgttccaagcgtttgcagaacggacaatcggggtcggagaagacggcgactttcagcttgccgttgccgcgcacttctttgatggctttgtccaaaggcagggaggcgaagtcgattttgttcaaatcggcggcgcgttcttcggtcaggtttttgcgcgtgtcgatgttgatgagttcgccgacgaacatatagccgccttcggcatcggtgtagataatctgcctgccgctgacgacgacttcgtaaatgcctttgaccggtgtttcgctgacgctcaacactttcaaatcttgggcggaataggttttttccaaacgcgctttcaaagaggcggcaacggatttgccggcggactcggctttgacggcgggttcggcgttggcattggaaacgggcgtttgcccgcaagccagcagcgggaggacggtaaagggggtcaagattttgattaacttggttttcatataaagatgattgcgcgtgttggaaaagcggaattgtatcaaatctctgttgcgcctgcattgcgcctaggctcaatttatcgtctgaaaatagcttccggctgttaaaatacgcaaaaaatgatttgcttgtttgtatgatttaccaccgcatcgccgtaaacgtgccgctttcagacggccttttgacttattcccattccgatccgcttcctccgggaacgcgggtgcttgtgcctttccgcaataaaaccgtggtcgggatggtgtgggaaacggatattgcgcccgatatggatatggcgcggattttgagtgttcagacggcctttgtggaagaaaagccgttgcctgaaagctggcgtgatttgttggcatttacgtcgcgttattaccactatccgactgggcaggcggtgtttgccgcgctgccgcagggtttgaaggaaacgcgcgcggtggaaatgccgcagccgccgttgttttatgctttgaacgaagcgggcagggcgcaaacgccgccaccagctcggttcaacaaaaaagcggctttgtgggacgcactgctttcgggcggaatgacgatggcagcgttgaagcaggtaaacgcgcaggcggcgaaattgattgaagattgggcggagcagggttggattgaaacaacggaagcggcgaaacctgtattgaggtcgtaccacgggcaggcttcgcactctgaatttgtgttgaatgccgaccagcaacaggcttccgatgaaattcagacggccttcggcagcttccagccgtttttgctgtacggcatcaccggcagcggcaagaccgaggtgtatttcgatgcgatggcgaaagtgttggcgcaggggcggcaggtgttgtttctgttgcccgaaatcaacctcacgccgcagcttttgaagcgggtggaaaaccgttttgccgacgtgccgaccgccgtgttgcacagtcagatggcggcaggcaagcgcacgcaggattatttgcgcgcgatgttggggcaggcgaaattggtcatcggcacgcggctggcggtgttcacgccgatggatgatgtcgggctgattgtggtcgatgaggaacacgacggctcgttcaaacaggacaacgaattgcgctaccacgcccgcgatttggcggtgtggcgggcgaagcagggcggctgcccgatcatattgggcagtgccacccccagcttggagagctggcacaaggcgcaaagcggcgcgtaccgcctgctgcaactgaccgaacgcgcccataccgccgcgcaactgccgcaagtggacatcctcaacgtaggccgtctgaaacttgacaacggcttctcgccgcaagccttgcagcttttgaaacagaactttgaagcaggtggcatgtcgttggtgtacctcaaccgtcgcggcttcgcgcccgcgctgttttgcggcgactgcggttataccttcggctgcccgaactgctccgccaaaatggtgctgcaccaacgcgcccgccaactgcgctgccaccactgcgaccaccgcgaacccatcccgtacaaatgccccgactgcggcaaccaagacctgaccgccgtcggccacggcacgcagcgcgtcgaagaaaccctgcgcaccttcctgcccaaggcagccgtcgtccgtgttgacagggacagcaccgcgcacaaaaacgactgggcggatttgtaccgccgcatcgccgacaacaaaatcgacattttggtcggcacgcagatgctcgccaaagggcatgatttcgcgcggctcaacctcgttatcgtgttgaacgctgacggcagcctgtacagcgcggactttcgcgccccggaaaggctgttcgccgagctgatgcaggtgtccggcagggcggggcgcgccgacaaacccggcaaggtgttgatacagacccaactgcccgaacatcccgtcttcgccgccgtcaaagcgcaggactacgccgtgtttgccgaaaacgaattgaacgagcggcaaatgttcgccatgccgcccttcggtttccagaccgccgtccgcgccgacgcgccgcgcgttgccgatgcgatggagtttctcaatgccgccaaagaaaccctcgccccgcttttgcccgaaagcgtttcacagttcggcgccgccccgatgctgatggtgcgcctcgccgaacgcgaacgcgcgcaaatcttcctcgaatctccgtcccgacaggatttgcaccgtgccgtgagtttgtgggcgcaggtgttgcagcaaaaccgcgacggcaaaatcagatggtcggtggatgtcgatccgcaggaggcttgattattggcaatccgatgccgtctgaaaaccgtttcagacggcatttttattccggatcgtctgtaaacgcattcgcccgaaatatcggtataaacgtgaaaagatacagtacgaatacggcggcggtcagaatcgcaggaacggtaatgaaaaatatcgggttcacgttcatcaagaaagcgcgcgagacggcggcggcgaaaaggatggggacggcaatgcggcagagtttggggtagtcgagtttggtaaagccgctgtgccacagtccggcggtcagccacaccatcatcacgccgcccatcatgccgccgagggtaatcaggtgcaggggcgcggaggcgggcaggttttgtaatttcgccgcgcctgtccacaaatagcctgcggcggcaaagagttggagcaggtaataagtgcggacgtagtgtttacgtaagagttcgtgatggtgaagctcacgcagcttggcgagcaggatgaagccgacggcgagcgcggtaaaaccggcggtttgcgcgggcagccaaagttcggcggcggcgtgcaagagcaggaaagtaatggcgatgtttttataaacgatatttggaataaaaacagggtctttcagacggcattctttcagggcttccgcgcccaaaagaatactgacgcgcacggatacgaacatcaccgccgccatatttagatgcacttgcgcgcgcaacaggttcaaatcgccgctgacggcatatgccgtctgaaaaacagtgaacgcggcaagtaacattagcagggcgaagttgtcggtgtttcggtctagccaaatcagccgggcgcagaacagcagcaacaccagccaataggcggcgacgaaaaacgaggcagtttgcggcgaaaagggcagtatagcggatgcggcgagcaataatgccgccatcaaagtcgcgacaggtttcaggttacccgaaaaacccgtccagtccaacaaagccgcagtcaaaaaaccgccgtatgccgccggcagcataagttccaagaaaatttggcggtgcaggacgatggcaccggggttgatgaaaaacaccagcgcaccgagtatggcaagcaccgccgcgccgacgaaaaacggccgcatagcaactgtatttttcaccccgtcgggcaaaaataccaaaactcaaatcaagccgtccggataccgttttcggcggtatcgttttcggcaaaataatcacgcatccgggcattcgatatcgtcagcagtttgcgcatacatgccgtaacggcaaccttatacggcttacccttggacagcaggcgttggtagaaatcccgaataagcggttcaaaacgtgtcgctgccacggtagccatatacagtgccttacgcaccgcagaccttccgccaaagcagcggcttttgaatttggtttcctcgctctccctcgggtgcggggcaatgccggccaaactcgctatccgtttgtgcgacagccgccccaattcgggcagcatcgccatcagcgtagccgtcgttatcgaaccgatgcctttgatttgctccgccacttgggctttgccgtcaaaatgcgtgtgggtgtggtcgtcgatttgtttgtccaattcgtcaatcagccggtcaaaatgggcaatcagttgtttgacgcttccgacttgcgtttcatgaacctaatgcagacggtttttctcggcagtccgcatatccaccagttggttgcggcggttaaccaaggcttccaacacttcttccacttcggtgggcgggtggtagggcatggtttgcgaaccttctttctgcgtcatcatctgtgcgaagaaggcgagcattttggcatctttggcgtcggttttggtcagcggctgcgattgggcaaactgatgcgtctgacgcgggttggcgataatcacggctatgcctgctcggcggatggctttggcggcggggatttcgagaccgccggtactttccgtcacgacgagggcgaccttgtgttttttaaggtattcgatagtatgggcgatacctttggggttgttggtttcggttttggttttagacaaagacgaaacggcgatgacgaagtttcgtttggcgatgtcgatatagtgaattaacaaaaatcaggacaaggcggcgagccgcagacagtacggatagtacggaaccgactcacttggtgcttcagcaccttagagaatcgttctctttgagctaaggcgaggcaacgacgtactggtttttgttaatccactataacagcaaccctgtcgccgtcattcccgcaaaagcgggaatccagtccgttcagtttcggtcatttccgataaattcctgttgcttttcatttctagattcccactttcgtgggaatgacggcggaaggtttttgtttttttccgataaattcttgaggcattgaaattccagattcccgcctgcgcgggaatgacgattcataagtttcccgaaattccaacataaccgaaacctgacagtaaccgtagcaactgaaccgtcattcccacgaaagtgggaatctagaatctcagactttcagataatctttgaatattgccgctgccttaaggtctggattcccgcttgcgcgggaatgacgaatccatccgcacggaaacctgcaccacgtcattcctacgaacctacatcccgtcattcccacaaggacagaaaaccaaaatcagaaacctaaaatcccgtcattcccacgaaagtgggaatctagaaatgaaaagcaacaagcatttatcggaaataactgaaaccgaacagactagattcccgcctgcgcgggaatgacgaatccatccgcacggaaacctgcaccacgtcattcctacgaacctatatcccgtcattcccacaaggacagaaaaccaaaatcagaaacctaaaattcgtcattcccgcgaaagtgtgaatctagaaatgaaaagcaacaggcatttatcgaaaataactgaaaccgaacagactagattcccgcctgcgcgggaatgacggctgcagatgcccaacggtctttatagtggattaacaaaaatcaggacaaggcgacgaagccgcagacagtacagatagtacggaaccgattcacttggtgcttcagcaccttagagaatcgttctctttgagctaaggcgaggcaacgctgtactggtttaaatttaatccactatataaaaaatttccagagaaccgatacaacagttggaacttgggtttgggaatattacggtagatgaacttggaacctctgttatgctatggtcttttatctcaattgaaaaaagcgcgaatcaaacggttcgcgcttttttcagacggtattaattattttttgtcgtcttttacttcttcaaagtcggcatctacgacatcatcgtctttctttgcagaagcattggcttgttcgctttcgcctgcttgggcttcagcttgtgcttgagcgtaaaccatttcccccagtttttggctggctgcgcccagcgcctcggttttggcatcgatagcggctttgtcgtcgcctttaactgcttcttcggcttctttcagcgcggcttcgattttttctttctcggctgcgtcgagtttgtcgccgtagtcggccaaagattttttcacagagtgaatcagggcttcggcttggttgcgggaagcgaccaattcagtcagttttttatcttcctcggcattggcttcggcatctttcaccatgcgttcgatttcttcttcgctcaaacctgaagaaccttggatggtgatgttggctgctttaccggtgcctttgtctttggcggaaacgtgcaggatgccgttggcgtcgatgtcgaaggttacttcgatttgcggcataccgcgcggtgcaggtgcgatgtcgcccaagttgaactgacccaaagatttgttggcagaagcgcgttcgcgttcgccttgcagtacgtggatggttactgcgctttggttgtcttcggcggtagagaacacttgcgacgctttggtcgggatggtggtgttcttctgaatcagtttggtcatcacgccgcccatggtttcgatacccaaagacagaggagttacgtccagtagcaatacgtcgctgcggccgccgctcaatacttcgccttggatcgctgcgcctacggcaacggcttcgtcagggttcacgtctttgcgcggttctttgccgaagaaggctttaacggcttcttgtactttcggcatacgggactgcccgccgaccaagattacgtcgtcgatgtcgccggtgctcaagccggcatctttcaatgcaattttgcaaggttcgatagagcgggtaatcaggtcttcaaccaggctttcgaatttggcgcgggtaattttcatcgccaagtgtttcgggccggttgcgtccatggtgatgtacggcaggttaatttcggtttgctggccgctggacaattcgattttggctttttcggcagcttctttcaggcgttgtagagccatcacgtcttgtttcaaatcaatgccttgttcttttttgaactcggcgatgatgtggtcgatgaggcgttggtcgaagtcttcaccgcccaagaaggtatcgccgttggttgccaatacttcgaattgtttgtcgccgtcgaggttggcgatttcgatgatggaaatatcgaaagtaccgccgcccaagtcatatacggctactttgcggtctttgttgtcgcctttgtccataccgaatgccaaagcggctgcggtcggctcgttgatgatgcgtttcacgtccaaaccggcgatacggcctgcgtctttggtggcttgacgttggctgtcgttgaagtaggcagggacggtaatcacggcttcggttactttttcgcccaagtaagcttcggcggcttctttcattttacgcaggacttctgcggaaatttgaggaggagacagctctttgccttgtgcttttacccatgcgtcgccgttgttggctttgatgatttcgaaaggcatagattcgatgtcgcgttggacttctttgtcttcaaatttgtggccgatcaaacgtttggcggcgtaaatagtgtttttggcgttggttaccgcttggcgtttggcaggcgcaccgacgaggatttcgccgccgtccaaataagcgataacggacggcgtggtgcgtgcgccttctgcgttttcgatcactttggtttgaccgttttcggaaatggccaaacaagagttggttgtacctaagtcgataccgattacttttgccatgtggataatcctatttgattttgcttattttgagaaatatgttggaacattttgtcccgatgggctgtaaatagggcgggcggcgggctgtttcaagctacagcatggctataagtatataactttatgaatatattggttttatatttgatttaatacatttggctccaatgcattcaagcataatgtttcaaatggcaggcaggtttattcatagacgatgccggcgagcatttcctgttcgttcaagttgccgtactctttttcccagtcgtgtgaagactcgatgatgtcgcattctttggaaagggagacttgttctgcatccatatctttggcgttcagtatgttgaattgttcgcacagggatgcggataaagtgatgtcgggctgtttggcttcagaacggttttcttggaaggcaaagcagaatgcggtaaatgccgcagtatagataagatatttgccggttttcttcatttttctatcctttttctgtcaattcaggattaaacctatggaaaaatctgaaaaattatgtattaagtaagaaaaatcataatttaaatttagtttatcataattgttccgttttttggatagctaaggaaaatatatttcatgtttactttagatgattgaatgaaggggagtggaaggatatttatggaaacctttaaagacagactggtttttttatggaaaagcgaagcgaggcaggcaaaaatcgcatccgatattgaaatgacgattgcgggcttcagcaggatatggaatgaaggcggtctgccaaagtctgaaacattgaaaaaaatcaagcagttgaaggggtgtagtatcgattggctgctgaccggggagggtaatccgtttccggatgaagccccaaaaaaatcccttgcttacgatactttgggcaatgaagtcgatacggacgagtttgtcttcgtgccgagatatgatattcgggcggctgcgggatacgggcagtttgtcgatcatgaggaaccggtatttacaatggcgttcagacggcattggattgagaattatgttacccgcgatacgaaaaacctgtctgtaatttccgtcaagggggattcgatggagggggttttgaatgacggcgattcgattttggtcaatcatggtgaaaatacgccgagggacggtctgtatgtgttgcggattaatgaaaatctgctggttaaacgtttacagattgtaccgggcgggattatcaatgtgatttctgcaaacgaggcttatcctgcttttgaaatcaatttgaacgatttgaccgatgatgtggagattatcgggcgtgtcgagtggttcggcaggacgatttgagtttggggcttgaaattgcaggcggtcaaacttatctattggaacaattcctttttcaaaggcgaagcctgcttgcctttgaagggggtttgagagagaatgcagaaaatattatattaaggaataacaccatgtcggatgaaagccctattatttttactgacagctgctgtgccaaagttgccgatttgattgccgaagaaaacaatcccgatttgaaattgcgggtttttgtcaatggcggcggctgttcgggtttccagtacggatttacttttgacgaaatcaaaaacgacgacgattttgaaattgagaaaaacggtttggtctttttggtcgatccgatgagctatcaatatctggtcggtgcggaaatcgactatacggaaagtttgcagggttcgcaattcgtcatccgcaatccgaatgcggaaacaacctgcggttgcggatcgtcgttttccgtatgaccgcttggtttgtgtgatgccgtctgaacgttcagacggcatttttacttttagaaaatatattatcgggatgaattcacatataatccgattgtttgaagatgaatcgggtttcccgaaaggaacgggcggaacggtatcaggcgtatttgttcccttatgattgagatgagtaaagattaccgaaacgatttgtacgatgtatatgtttcttacccgccccaagtggatcgcgggcttatccgggagtgccttaaggagaatctcggcgaggaaaaggcggaaggattgatcgaatcgctcgattccaaacctcaagtgctggttgaggaaaaatgcacttgggcgaaacgggaagagttgcatgattatttcagctatttgggtttggatattattacccggagatatatggagttggaaacggtcgtgccgccggaggaaggggagggcgaaggagaaggcgcggatggggaaatgcccgaatatcttgaacttcacggcgggcgggaagatgatatttccgcaccttcgcaacccgaaccgccgtcccgcaatatcaaactgctggttttcgggctgctgattgcctttttgggctatctgctcggtaagattttttgattgtccgataaatgctgtattcgggattttatatatgaaatggttgaaacgcctgacggttattgtcgggactttttaccgctatcggctggcaggtctgtgtgcttcgctgatgggtagcggttggatatgcgctctgctgaaaatgatgccgcagtcgtccaaattgaaaaacgaaccgcctgctgtccgtctgcgccttgccttggaaagcctggggccgattttcatcaagttcgggcaggttttgtccacacgccccgatttgattccgcacgattacgccgtcgaactggcaaagctgcaagacaaagtgccgccttttgacgcgcggctttcgcgtgaacaaatcgaaaaatcgttgggtcagtccatcgaaaagctgtatgcggaatttgaaaccgagcccatcgccagcgcgtccatcgcccaagtacacaaagcccgcctgcattcgggcgaacaagtggcggttaaagttttgcgccccaaccttttgcccgtgatcgaacaggatttgtcgctgatgcgctttggtgcaggctgggtcgagcgtctgtttgccgacggcaagcgtctgaagccgcgcgaagtggtggcggagttcgacaaatatctgcacgacgagttggacttgatgcgcgaagccgccaatgccagccagctcggacgcaatttccaaaacagcgatatgctgattgtgccgaaggtgttttacgactactgcaccagcgacgtgctgaccatcgaatggatggacggcacgccggtttccgacatcgccaaactcaaagcagacggcatcgatttgcacaaactcgccgattacggcgtggaaatcttcttcacgcaagtcttccgcgacggctttttccacgcggatatgcaccccggcaatattttggttgccgccgacaaccgctacatcgccctcgatttcggcatcgtcggcacgctgaccgattacgacaaacgttatctcgccatcaacttcctcgccttcttcaaccgcgattaccggcgcgtcgccaccgcccacatcgaatcgggctgggtgcccgccgacacgcgcgcggaagagttggaagcggctgtccgcgccgtgtgcgaaccagtgttcaacaaaccgatttcgcagatttccttcggcttggtgctgatgcgcctgtttgaagtcagccgccgcttcaatgtcgaaatccagccgcagctggtattgctgcaaaaaacgctgctcaacatcgaaggcttgggacggcagcttgatcccgatttggacttgtggaaaaccgccaaaccgtttttggtgaaatggatgaacgggcaggtcggccctaaagccctttggcgcaacctcaaaaacgaagcccccgactgggcgcaaatcatcccttcattgccgcgcaaaatcagtgcgttgattgatgaaaaccgccagcaggaaatgcgtgatgcctatatccatttggtcaaagtgcagcagcggcaaagcctgtggctggctgtgattgcggttgttttgctgctgattttgcttttgaaataggctttgtccgaatcatcgcccgactccgcccgtttataaggaaatcggttatagtggattaacaaaaaccagtacggcgttgtctcgccttagctcaaagagaacgattctctaaggtgctgaagcaccaagtgaatcgattccgtactatccgtactgtctgcggcttcgtcgccttgtcctgatttttgttaatccactatatttccggttgcgtgggaatcgggtgtattgaataaaaggcattttgtccgactggcaagtgccgacatcggcggcatatcaaggcgcaggcttgaagcgggcaatgtcgtctgaagcccgtttggcgtttcagacggcattggtgcggatattcaaatcataaagtcgatttcggtaaactggatattttgatccatatccgccgacggtgttttgagcgatcgcgccacgggtttggcgggtacgccgacaaccgtgatggacggcggcacgtctgaaaccacgacgctgcccgccccgattttggcattgctgccgatgcggatattgcccaatatcgaggcgtttgcgccgatcatcacgccgtcgccgattttagggtggcggtcgccgccttctttgcccgaaccgccgagcgttacgccgtgcaaaatcgaaatattgttgcccaacacggcggtttcgccggcaacaaagccggtggcgtggtcgagcatcagcccgtatccgaaacgggcggcgggatggatgtccacgccgaatacttcggacatacggttttgcaggaaatacgccagcgttttgcgcccgtcgagatacagccgatggttgatgcggtgtgcctgaatcgcgtggaagcctttgaaatataaaagcggcagcgaatattcgtcgcaggcgggatcgcgttcgtagatggcttttaagtctgcttcgacgcatttgccgatttgggtgtcgctgcccaacgcctgctggtagatttcaaacagcgcgcgcacgtccataatcgggctgccgagtttgctggaaaggtggtaggcaaggacggagccgagggactcgtggcgcaacacggtttggtgcaaaaaacttgccagcatcggttcggcggagaccgcggccgcggtttcttcgcggatggtgtgccagaggtcgaaaccggttgtgtttaaatggtcttttttcatgagtgatgacgtttgaaaatcgatatggtcggcagtatcttaccgtctatattattttttcggtaggggatttgaaaatgaatttgaaattctctgmttttgmttgaagtttcttgaaaatgtccttatcttgcgcgggtaataactggattttgatttccaatttgttttaagggatacgatatgagcgaacagacacagcagcaaaacagtgaagaagcggttgaaaatgtggaggcggtggaaaccgtcgagacagtaggaaatgcggacggtgtgcaggaacaggctgccgcagagccggcttatgaggatttgcaggcgcggattgccgagctggaagcgcagttgaaagacgagcagctgcgcgctttggcaaacgagcaaaacctgcgccgccgccaccagcaggaaattgcggatacgcacaagttcgccggacagaagtttgccgtggaaatgctgccggtcaaggattatctggaaatggcgcttttggatcagagcggcaatttcgatgcgctgaaaatgggcgtgcagatgactttgaacgagttgcagaaagcatttgatgctacgcaaatcaaggaaatcaaccctaaagcgggcgataagctcgatccgaatatccatcaggcgatgcaggcggtggcaagcgaacaggagccgaataccgtggtgggtgtgatgaagaagggttatacgctgtccgaccgcgtgttgcgcccggctatggttacggtggcgcagaaggaagcctgaaggcgtctggggaataatctgatttatttcctgaagcgcgttttgcgtataaaccgatcgaagtaaagcggcaatgccgtctgaacccgcctgtcgggcttcagacggcattttatagtggattaacaaaaatcaggacaaggcgacgaagccgcagacagtacagatagtacggaaccgattcacttggtgcttcagtaccttagagaatcgttctctttgagctaaggcgaggcaacgctgtactggtttttgttaatccactatatttcggcgttaacggtcaacccgtatgccgcctgcctgtttttcttcatccagtttcttttgcagggtgtcgcaaggtgtgtcgcagtcgcacatttttttcatacccaaggcagtaatgccgccgcaactgcctttgatgctgcgtttggagaaaatatagccgaccgccataccgatgatgacggtcaggaagatgccgaaggtaaggagcagggttttcatggtgtttcctaatcggtttgtatgtttagcggagcagtttttcaaattcggaagacatggcggtgcggtagccgcctttatccctgacaatcaggaaaacagcgagtttttcgcgctctgccagctttaaggcttcggtttcgcccaatacgaataatcctgtggacaagccgtccgccgtcatcgcactgtctgcgaccacgctgatggaggcgaggttgtggctgatgggtcgtttgttgttcgggttgatgatatgggagaggcgtttgccgtttttatcgacgtggaaaatacggtaatcgccggaagtggcaagcgaacggttgttcagcgggacgataatctgcgtattgccgccttggacgatattgggctgctcgataccgatgcgccacggttcgccgcgcgcgtttttgcctttgccgtgcaactcgccgccgatttcgaccagataattttgaatgccgtatttttccagttcgcccgcaactttatcaacgccgaagcctttggcaatcgaagataaatccaaataggccttggggtgggttttgctcaaggaagcgtaatctttgccttgtttcaaaatgattttgtctatgcccgtataagatgccgcctgtttgatttgttccggcgacggttcacgggtaacggatttgtcggggccgaatccccaaaggttgaccaaggggccgacggttacgtccagcgcgccgtgtgtcaggcggttcaggcggacggcttcggcagtaacgtgtgcgaagtcgcttgaaatgcggaggggcttgccggctgtgtgttggttgaaccggctgatttcggagtcgggctgataggtggacatctgccggttgacttctttaagcgcgtcatcgatgcgtttttgtatttcggcaggtgaggggagtttgtcccgattatttgaaaggtatttgacggtataggtcgtgcccatcgtttcgccttgcagggtaacggtttgcgcggtttgttccgaacaggcgttcaggaagatgaaacccagggcaaatatcaagacgcggataaagttcggcaggcgtgtttcagacggcatagtgtttgacggttttggcaaatggtttgaattatatcgcaaaacggccggtatgtttctatgccgatgccgtctgaagggtgttcggatggcatcggcatagaaaaaggaagaaaccgaggtttcttccttttgtatttgaagccgaatatttaaccgccgaaatcgtccaagaggatgttttcgtcttccacgcccaagtctttgagcattttgatgacggactggttcataatcggagggccgcacatataaaattcgcagtcttccggtgcttcgtggtttttcaggtggttttcgtaaaccacgttgtgaatgaagcccgtgtagccgtcccagttgtcttccggcagcgggtcggacagggcgacgtgccacgtgaagttcgggaactctgccgcgagttggtcaaagtcttcgacatagaacatctcgcgtttggaacgtgcgccgtaccagaaggtaatcttacgtttggagttcaaacgtttcaactggtcgaaaatgtgggaacgcatcggagccatacccgcaccgccgccgataaataccatttcggcatcggtgtctttggcgaaaaattcgccgaacgggccggaaatcgtaactttgtcgccgggtttgagcgaccagatgtaggacgacatttgtcccggaggcgcatcaggtacgcgcgggggcggcgtggcgatacgcacgttcagcataatgatgcctttttcttcaggatacgaagccatagagtaggcacgcaaaatcggctcgtccactttggaaacgtattgccacaaattgtatttgtcccagtcttcgtgatattccttaggaatgtcgaagtctttgtaggcaacagtgtgaggaggagcttcaatttgaatgtagccgccggcgcggaaggggacttcttcgccttcgggaatggcaagcttgagttctttaatgaacgtggctttgttatcgttggagatgacggtgcattcccattttttcacgccgaacacttcttcggggacttcgatgtccatgtcggttttgacgttgacttggcacgacagacggcagccttcgcgtgcttcgcgtttgctgatgtgggacagctcggtcggcaggatgtcgccgccgccgctttttacgacgacgcggcattgtccgcacgaaccgcccccgccgcaggcggaggggataaagatgccttcgttggcaagcgcgcccaagagtttgccgccggcgggcatcgtcagctctttttcgccgttgactttgatggtgatgtcgccttcgctgaccagtttggatttggcaaacagaatcatcagtgccaaaaccaaaacgatgacggtaaacatcacgatacctaaaataatctccataccgatccctttcttataactggatgccagagaacgacataaacgccatcgccatcaggccggcggcgataaaggtaatgcccaagcctttgaggcctttgggagcgtccgaatatttcattttttcggtaatgcccgccaaagcgacaatcgccaacatccagcccaagcccgcgccgaagccgtatacaacggactcgccgaagttgtattcgcgttgcgccataaacgatacggcgccgaaaatcgcgcagttcacggtaatcagcggcaggtagatgcccaatgcgttatagagggcggggacgaatttatccaagaacatttccaaaatctgcaccaaagcggcaatcacgccgatgaaggtgatgaatttcaaaaaggtcaaatccacgccttcggcaatcgcgccgtctttgagcagcgagtaaacgagttggttgacagggacggacagcccgagtacgaaaattaccgccacacccaaaccgaatgcggtggatacttttttggataccgccaaaaacgtgcacatacccaaaaagaaggatagtgccatattttcaatgaagacggatttgatgaagaggctcaaatagtgttccatagcttattcctccgcctgttcgggtttccaggtacgcagtccccaaatcaaaaagccgatgatgaagaacgcgctgggggcgagcaggaacaagccgttggtctgataccagccgccgtcctgcacggtttggaaaacggtgtagcccaagagtttgcccgagccaatcagttcgcggacggtggcgacgacaagcagcattatcccgtagcccgcgccgttgccgatgccgtcgatcaggctttccagcggcggctctttcatcgcaaatgcttcggcgcggcccatcacgatacagttggtaataatcagaccgacgaatacggaaagctgtttggacaattcgtaggcaaatgcctgcaagagttggtcgaccagcgtaaccagcgacgcgataatcgccatttgcacgataatacggatgctgttggggatgtagttgcgtaccagcgaaatgaagaagctggaaaaaccggttaccaaagctacggaaatacccatcacgatggccgtctgaagtttggtggtaaccgccaaagccgaacaaatacccaaaacctgcaaggcaatcgggttgttgtcgataaagggtgaaaacatcaaatgtttcaagcgtttcatatcagccattattgcgctcctgctgatttcaatttgttcaggtaggggatatagccgttttcgccgaaccagtaggcgaacgaaccttgcacgcctttggatgtcagcgatgcgccggagagggcatctacgccgtgttctttgtccgaacccgcgcctttgccgacgtgcagggcgagtttgccttgtccgtcaaacagttttttgccgacgaatttttgctgccacaacggattgccgatttcgccgcccaagcccggggtttcgccttgttcgtagtaggtaatgccgttgatggtgttgccgtcgggctggatggcgacaaagccgtacatgaccgaccacaaaccgttaccgtgcataggcaggatgatttgcccgattttgccgtcttcgccttttaccaaataaacctcggtgtatttggcacggcttttgatgcctgccaaatcgtcttcggttttgatgcggatgctttgggcagggtctttgcctgcgatgcgcgcgctgaagtctttaggcgcatcggcgacgtattcgccggtcgccaaatcgacaacacgttgctcgatacgctcggcaaaggttttaccgatgtcggtgtccttatccatcaaaccggctacgctcaagatatagccttgtttgtcttggagtttttgtttctcttggatgggtttcaagccgacgaccgcaccggcaacgatgaccgagcaaatcaggctgaccgccaacacgacaatcagcgtgccgctgaagctgtctttatcgaatttcttagccattgctgcgcgcctttctgcgtttgatgttcgcttgtgcgacgaaatagtcgaaaatcggggcaaacaggttggcaaacagaatcgccaacatcatgccttcggggtaagccggattgaccacgcggattaatacgcacatcacaccgatcagtgcgccgtaccaccatttgccgacattggtaaaggaagcggaaacagggtcggtcgccataaacagcataccgatggcgaagccgccgaccaccaagtgccagtaccaaggcatagcaaacatagcgttggtgtccgaaccgatgaagttgaacagcgaagacatcgcaatcataccgatcatcacgccggcaataatgcgccaagaagcgatgcgggcaaacacgataaacgcgccgccgattaagagtgccaaagtggagacttcgccaatggagccgggcagtttgccgataaacgcgtccatccaagtgatggtttgaccggttacggcgtttttcaggccgtctgcaccgtgtgccgcccattgcgccagtgcggttgcgccggaatagccgtcaaccgccgtccaaaccgcatcgccgctcaagttggcagggtaggcgaagaacaggaaagcacggcctgccagcgcagggttcatgaagtttttacctgtaccgccgaatacttctttcgcaaccacaacgccgaaagaaatacccaaagccgcctgccacagcggcagcgtgggcggaacgattaaggcaaacagaatcgaagtaacgaagaaaccttcgttgatttcgtgtttgcgcacggtggcgaacaaaacttcccagaaaccgcccacaacaaatacagtcgcgtaaatcggcaggaagtaaatcgcgccaaacagcattttgtccgacacgcccgcttcagacgacatattgatgcccaaagcgttggcaaaggcgtaatgccagtcgttggcgatgttttgttgcagcaaatcaggcgttaacgcaccgaatgcctgcgcgccgacgttgtacataccgtagaacatggcagggaacaaagccagccacaccaaaatcatcatgcgcttggagtcgagcgcgtcgcggacgtgcgccgctttgcgcgttaccgcgccggatgtgtagaaaattgtcgccgcagcttcgtagagggcataccatttttcatgtttgccgcccggcaggaagtgcggttcgattttttccagaaaatgtttcaagcccataatcagccttccttctcaatggtttccagcactttgcgcaacagcgggccgtattcgtatttgcccgggcagacgaagctgcacaaagcgaggtcttcttcgtccaattccaagcaacccaatgcctgcgcgctgtcggtatcgccgacgattaaatcgcgcaaaagcagggtgggcaggatatccaagggcatcacgcgctcgtaagtaccaatcggcaccatggcgcggtcgccgccgttgacggctgtgttgaacttgaagagtttgtttttcaggaaatggccgagggttgtacgcgtgatggagtatttgtccggctgcggcgcaacccagccgaacagctctttgctgcggccttcttcgataacggaaatctgattgtggtagcgtcccaaataatcgtgcgcgccttgtgtaatcgcgccgttcaataccgaaccggaaatcacgcggttgtctgtgtcaaccaattcgcccgcagtaatttgcgatactttcgcacccaaaacggtacgcaagaggcgcggtttgttgacttgagaaccacctagggcaatcacgcgctcggtgttcagacggcctgttgcaaacaaacggccaatggtaattacatcttgataattgatggtccacacggttttattcgcgccgaccggctcgatgaaatgaatgtgcgtgccactcaaaccggcaggatgcgggccgccgaattcatgtgtttcgatgttggcagcattttcagacggcacgtctgcgccagctgccttacaaacatggattttgcgttcggtcaaacggctcaataccaacaggccgcgtttgaaatcctcggcggcttctttgataatgaccgtagggtcggcagccagcggattggtgtccatcgcattgacgaagatggcgaacggctcggcatcgacggcaggaattttgctgaacggacgggtgcgcagcgcagtccacaaaccggattggatcaggttgcggcgcacttcttcgccgcttaagtttgccagcgcttcaggtgcgtagcgttcaaactcgatttcgtcgttgccttcaacggcaatcacgactgactgaagtacgcgcttttcgccacggtgaatcgcggcgattttgcctgaagccggcgcagtaaacaccacgcccggattctttttgtcttcaaacagcacttggccttttttgacggcatcgccttccttgactttcatcgaggggcgcataccggcatattcttcgccaagcaacgcgacttcggtaatggccgggccgtcgtaaacggcttgctccggtctgcccgcgatgggcaggtttagaccttttttgattttaatcatatatttgcattacttgtgatggttaaggtaaaaacggcgtgttttgataccgtgtcgcgtggcatcaaaagcattgaataaattaatgtagcaaagtgttagattctatcaggaattgtacctgtttgtcagatttgctgcttttttccttgcggaagccgtttttatagtggattaaatttaaaccagtacggcgttgcctcgcccttgccgtactatttgtactgtctgcggcttcgtcgccttgtcctgatttttgttaatccactataaattgtcggaaggggggatattgatttgattatgccggaatttaaaatgccgtctgaatgttcagacggcatagcgtttacagcagtttgaaaacgaaaaagataagggtatgtacgatgaagacgggtgtcaggaaggcgaccgaccacatcatatagccgaagaaagtcggcatcggtacgccgcgctgttcggcaatggccttgaccatgaagttcggtgcgttgccgatgtaggtcagtgcgcccatgaataccgaacccatagaaaccgccagcagcgaatgaaacagggtacccgtcatcaaggcttgggcatcgccgcccgccatattgaaaaaaacgagataagtgggcgcgttatccaagaatgccgacaatatgccgctcatccaaaaatacatcacattaatcggatgacctgccgtatcgtgaaccagcgataccaccccgcccagcgcgcctgcctcgcctgctttcagaatgctcaggacgggaaagatggtgatgaagatgccgaggaagagtttgcccacttcggcgatgggttcaaagttgaattcgttgcctgcgcggacttgtttgggcgtgattgccatagatacggcggtcaatgcaatcaggatgacatcgcggacgaggttttgcagggcgtaacggctgccgaggatttcaaatcccgggtgttcgggtttccaaaggccggacattagaaccgcgccgaccacgcccgaaagcaggaggaagttccatttgccgaagatggcgattttttcgggtttttcctgttgtgccggcgtatcttgtgcaatgctttcctgtttgaagaaacggttgtcgatgaaatagaaggcggtcaacaggacagcggtgctgatcaggacgggggcgaacatatgtttgaccgtccacatgaaatctacgcctttgaggaagccgaggaagagtggggggtcgcccaaaggggtcagaccgccgccgatgtttgcaaccaggaaaatgaagaagatgacgatgtgcacgcggcgggtacggttttggttggctttcagcagcggacgaatcatcagcattgctgcgccggtcgttcccatgatagaggcaagtgccgtaccgacggcaagcagggcggtgttgagcttgggtgtgccgttcaagtcgccccaaaccaaaatgccgcctgaaatggtgtacagggcaagcagcagcaggatgaaagggatgtattcttcaacgagtgcgtgtgcgacggtatggataccggcggacgcgccaaaaaccaaactgaacgggatgaggaagagcaatgtccaaaaggcggtaattttgccgtaatggtgatgccaggtatgcgaaaaaaacaagggacccaatgcgatagacagcaaaatcagggcaaagggcaggccccacagcaggtttaggtttgcgccgtccaaatctgcggcgtaaaccgatgctgggaaaagcattagtgaaaacaggggtaggtggcgcatcgtgtttcctcgattcaagcactgccttgcgcggcgcgtgggagtgatacaggcaccgtgccgcccggacataggcggactgtgctgcctgtttgtttttgaaaaaagttttccgattgattgtaaagtaaataatcaggataaaccagtttcccaaaccggaaggcggcgggaaggcggattgctgtgcttgggaatatatgttctttttgataaataattttatttaaaacaaataaatatatgtctttaataaataatctatcgaaaacgaaaaatgaatttattttaacatatatttgcaatgaaacaggtttgcccccccccgtttgtttgcccttatccctttcagtacggcattcaagattcgggcctgcgccacatccatatggcgacaagggaacaaaaaaccgatgaaaccgccccgacccaccagcgttggggaaactgccaaaacattatcaggcaggatgcggtcatcatactgatggcgaatattttggctttgcgcggcactgcgccgttttgttcccagttatgaaccatcgggccgaaatagcggtgccggtgcagccagcggtaaaagcgcggggatgcctttgcccagcaggcggcggagagcagtacgaacggcgtggtcggcaacagcggcaaaaaaatgccgatgatacccaacagtagggaaatgcagccgcaggcaattaaaagataacgtatcattttgaaatatttttcttattgtgcggataagggcaggatgtgataccgagttttgcccagccttcatgtcccattttttccagcagggcgatattgcgttcgaatattgccgaagcgtcgggaaaggcttgtgcggctttggcaatgctgtcttcgcggatgaggtgcagcgtcggatagggagaacggttggtgtagttgccaatgtcgtctgaatccgtgccttcaaattggaaatcgggatgaaacggggcgatttggacgatgccttctaagccgttttcgacaacggcggcatcggcaatgtcgagcatatcgttgaatacgtcgaaatcggggaatagggtcgggtgaaccagcagggtggtttccagttcggtggcgggtgtattgcccagtcgctgcagttcttcgtccaagtcttccaaaaaaccgtcaaggtgtttggcttcgctgatcgcgatgcggacaaggtttttaacgtggggggctttggcaaagggacacaggttcagaccgatgacggctttttccaaccattgtccggtgtgttcggcaacagcatctttattttcggaagtattgatattcattattgtcatgtaaatgtgtttgcagattgcacgtgcgggaaaatcgggaagggcactattccttcagcaggtggttgagcggcagggaggtggtgtgtttgatttcttttaaaacaaagctcgattgcgcatcttgtacgccgtggtgggacaggagcgtatccaaaacaaaatgggaaaacgcgttcatatcggtaaaaaacgcctgaagcaggtagtcggtttcccctgtcagggcgaagcagctcaagacttcaggccattttcgaaccgatgcggcaaagtcttcccgcgcgtcttttgctttgcggatggaaacgcggataaatgcctgaagtcccaagttgacagattccggagacagcagcgcggcatattggcggacgataccggcatcttccaactgcttcagacggcgcaggcacggagaaggcgaaagtgcgacacgttcggacagttcgacattggtcagcctgccgttttcctggagaacctgtaagattttaatatcggttttgtctaaagtgagttggggcatatttgcgttccgttttaaggaattcggattgtctgtccgtatgtttgcggcaatccgcacagatggagaccatattaacatataaaaagttataccgtcatccgggacaaattttgttttcggaaaatcatgtgaaaacagaggcggtcggtttgcatctctttaagacggcttgcccaaaccgccgattcaagacataatcgggaaatgtgcaggagagtgttacacccaactacaatgtaaccaccgaaggcgcagacacccttaaatcgctcaggtatcagggactgcacattgaaacaaacaatctggagagcggcgttggaataacgtccaccgaaggggagaaggccgtctgaaccaccattcagacaaccgcgcaaagcagtgagcagactggtttgccatcatgcggatacagccgaaaatctcaggttcaaggacagatagggtcatccgcgcacaggtgcgcgggcggcatctgaacaaaaaatccggagaaacttgagaatgactgctctgaaaaccaccccatttcatcaagcccatcaagatgcaggcgcgaagctggtcgattttgccggctgggagctgcccatccattatggttcacaaatcgccgaacacgaagccgtgcgcaccgacgccggtatgtttgacgtatcccatatgctcgttaccgacgtagcaggcgcaaatgccaaagcctttttccgcaaattgattgccaacgatgtcgccaagctcgcttttgtcggcaaagccctttattccgctttgctcaacgacaacggcggtgtgattgacgacttaatcgtttaccgcaccaatgaagccgaaacccaataccgcatcgtgtccaacggcgcgacccgcgaaaaagacacggcgcaattccacaaagtcggacaagagttcggcgtcgccttcaatccgcgctacgacctcggcatgctcgccgtacaaggccctaaagccattgaaaaactcctgaccgtcaaacccgaatgggcagatgtcgtccataacctcaaaccgttccaaggcgcggatttgggcaacgactggtttgtcgcccgcaccggctacaccggcgaagacggcgtcgaagtcatcctgcccggcaccgaagccgtcgcattcttcaaagccctgcaacaagccggcgtacagccctgcggcctcggcgcgcgcgacaccctgcgcatggaagccggcatgaacctctacggcaacgatatggacgacgacaccagcccgctcgaagcaggtatgggttggaccgttgacttgaaagacgaaagccgcgacttcgtcggcaaagccgccttgctggcattgaaagaaaaaggcgttgccgtcaaacaggtcggcctgttgctcgaaaaaggcggcatcctgcgcgcgcatatggaagtgttgaccgacaaaggccaaggcgaaaccaccagcggcgtattctccccaagcctgaaacaatccatcgccatcgcgcgcgtaccgaaagattttgacggcgataccgccaaagtgctgatgcgtggcaaagaagtggacgtgcgtgtactgaagctgccgtttgtccgcaacggacagaaacagtttgattgatgcggtttcagacggcattttcatttcatatgccgtctgaaagcaggttttaattgttgtccgatacggacgtttgtagaaagcattgaacaaggcatctgtggatattgattcatgcagatgccgtctgaaaataacccctatcaatggagtatcaaaccatgagcaacaacatcccggccgaactgaaatacgttgccagccatgaatggctgcgccttgaagaagacggtacgattaccgtcggcattacccaccacgcgcaagagctgttgggcgacatcgtgttcgtcgagctgcccgaagtcggcgcgaaccttgccgctgaagagcaagccggtgtggttgagtctgtaaaagccgcgtccgacgtgtacgcaccgattgcaggcgaagtcgttgccgtcaacgaagatttgccaagcgctccggaaactgccaacagcgatccttacggtgcaggctggttcttcaaactcaaaccggcaaacgttgccgattacgacagtctgctgactgccgaacaatacgcgggcgaagtggattaaaccgcccggctgcccgacggcaaccgccggacaaacggaaactgcaccttcagacggcatttttgcggtcggaggtgcagttttttgtccgtgttttaaggaagcagttaggctataataacggtctatattcatctttaccgattttttcatgcaacttaccgctgtcggactcaatcatcaaaccgcacctttaagcatacgggaaaagctggcgtttgccgccgccgccctgcctaaagccgtccgcaatcttgcccgaagcaatgcggcaacggaggcggtaatcctttctacctgcaaccgcaccgagctttactgcgtcggtgattcggaagaaatcatccgatggcttgccgattaccacagtttgccgattgaagaaatccgtccgtatctgtacgcgctggatatgcaggagactgtgcgccatgctttccgcgtcgcctgcgggctggattcgatggtgttgggcgagccgcagattttaggacagattaaggatgccgttagggttgctcaagagcaggaaagtatgggtaagaaactcaatgccctgttccaaaaaaccttttccgttgctaaagaggtccgtaccgatactgccgtcggcgaaaactcggtttccatggcttccgcttccgtcaaattggcggaacagatttttcccgacatcggcgatttgaatgtcttgtttatcggcgcaggcgaaatgattgagctggttgccacttattttgccgccaaaagtccccggctgatgacggttgccaaccggacgctggcgcgtgcacaggagttgtgcgacaagctcggtgtcaacgccgaaccgtgcctgctgtccgatctgcctgccattctgcacgattacgacgtagtggtttcttcaacggcaagccagttgcccattgtcggcaaaggcatggtggagcgtgcattgaaacaaaggcagagtatgccgttgttcatgcttgatttggcagtgccgcgtgacattgaagcggaagtcggcgatttgaatgatgcctatctttatacggtggacgatatggtcaatatcgtccaaagcggcaaggaggcaaggcagaaggccgccgccgccgccgaaacgctggtgtccgagaaagttgccgaatttgtcaggcagcagcagggcaggcagagtgtccccttgattaaggcgttgcgggacgagggcgagaaagcgcgcaaacaggtgttggaaaatgccatgaaacagcttgccaaaggcgcaacggcagaagaggttttggaacggctgtccgtccaactgaccaacaagctgctgcattcgccgacccaaaccttgaataaggcgggggaagaagataaagatttggttcatgccgtcgcgcagatttatcatttggacaaataacggtgcgccgggaaaaatgccgtctgaagaggtttcagacggcatttttttgtgccgcctgacaacatcgtgaaatcccacattatatcgatgtaatcacaaagtatagtggattaacaaaaatcaggacaaggcgacgaagccgcagacagtacagatagtacggcaaggcgaggcaacgctgtactggtttaaatttaatccactatattatcccgtatgcggattggttttaagatttgtaaatttgatttgcatcaaaaaatcgccgatagatgattcatataatatcaatattaaagagtatcggtatatcggggatagtcatgtcctgtttttcaatcaaacgtatgtccgcgtttcgggcgcggataacggcgttttttgccgcctttgtctttttgacggcggcactgcccgcttatgcggagcgtctgcctgattttctggcgaaaatacagccttcggaaatttttccgggtgcggaccgttacggcaagccggaaggtaagcctatggttgcccgcgtttacaaaggcgatgagcagttgggcttggtctatatcacgaccgatgcggtcaatacgcgcggttattcgagcaaaccgattgatacgctgatggtgttggcaaacgacggcacgatagccggggcgaaactggtcgaccatcacgaaccgattatgctgatcggtatcccgcatttgcccgcgcccgggcgggcgatacgctcaaactggcttccggcgtatataaaaccaaacttcacattgacaaaccgattacgattgaagggcctgccgaccgttccgcaaccatcgaaggcgacaggagcgggcgtaccatagccgtacacgcgccggacgtaacgctccgcaacctgaccgttacccgttccggtatgagcctgcccgcaatggatgccggtatttatctcgaagaaactgccccgcgcgccctgattgaacacaacaatattttggataattcggtcggcgtatatctgcatggttctgccgatgcgatggtgcgcgagaataaaatcgtcggcgacgcgactttgcgcgtgaacgagcgcggcaacggcgttaccgtttggaacgcacccggtgcgcaggtcgtcggcaacgacatttccaaagggcgggacggcattttttccaataccagcacgcacaacacctacaaaaacaaccgcttcagcgatttgcgtttcgccgtccactatatgtacaccaacgacagcgaaatcagcggcaatatttccgtgggcaacaatatgggctatgtgctgatgttttccgagcggctcaaagtattcgacaatatcgccgtcggcagccgcgatcagggcattatgctcaactatgtcaactattccgatattcacgacaacattatcaacaaggcaggcaagtgcgtatttgcctataatgccaactacgataaacttttcgccaatcattttgaaaactgtcaaatcggcatacactttaccgccgccatcgaaggcacgtccttgcatgacaattcctttatcaacaacgaaagccaggtcaaatacgtcagcacgcgctttctcgattggagcgagggcggacacggcaactattggagcgacaacagcgcgttcgatttgaacggcgacggcttcggagacagcgcgtaccgccccaacggcatcatcgaccaaatcatctggcgcgcgcccgtatcgcgccttttgatgaacagtcccgcaatcagcatcgtcaaatgggcgcaggcgcagtttcccgccgttctgcctggcggcgtggtggacagcaaaccgctgatgaagccttatgcccccaaaattcaaacccgttatcaggcgatgaaggacgagctactcaaagaagtcgaaacgcggcagtcggaatggggcagggcggaaaacggttctttgaactagtctgcttcagacggcatccggattcaaatgccgtctgaaaacacaaaaggaacaaccatgaccacacatcatgtcgaattgaggaaggtaaccaaacggttcggggcgcaaaaagccgtcaaccaagtcgatttggttttgaaggcaggagaaagcgtcgggcttgccggacacaacggcgcgggcaagtccaccattatgaagctgatactcgggctgattaccccgaccgaaggcgaagtgatgcttttgggcgaacgtaccggtagcaaagcgggggcgcggcttcgcagccaaatcggctacctgcccgaaaccgttgcgctgcacccttcgctgatcggcatcgaaacgctggatttttatgccaaacttaaaaaacagccgctcacgcagaaccgggggctgcttgagcgcgtcggcatttcacaggcggcacaccgccgcgtcggcacttattctaaagggatgcgccaacgccttgccttggcacaagccctgctgggcgagcccaaagtcctgctgtttgacgaaccgacaaccggtcttgaccctgcatcacgacaaatgttttacgaagtcgtgcgcgaactcaacgggcgcggcgcgaccgtattgctcagcacccacgcccttgccgagttggacgggcacgccgaccgcattatcgtggattaaatttaatccactatatgcgggtatggcgggtttgagcggacaaatcagcctgaccgtccccgttttgctgaccgctcaggttttatgggttatcattccgcttgttttggcagccggaatttttagaaagcgacaaatatgaaaaaaaccctgttggcaattgttgccgtttccgccttaagtgcctgccggcaggcggaagagggaccgccgcctttaccccggcagattagcgaccgttcggtcggacactattgcagtatgaacctgaccgaacacaacggccccaaagcccagattttcttgaacggcaaacccgatcagcccgtttggttctccaccatcaagcagatgttcggctataccaagctgcccgaagagcctaaaggcatccgcgtgatttacgttaccgatatgggcaatgttaccgattggacgaatcccaatgccgacacggagtggatggatgcgaaaaaagccttttacgtcatcgacagcggctttatcggcggtatgggtgcggaagacgcgctgccgttcggcaacaaagagcaggctgagaaatttgcaaaggataaaggcggtaaggttgtcggtttcgacgatatgcctgatacctatattttcaaataatattgaaaaaaccggccgaaactttaaaaacgagtttcggtcggtttttcttttcttgttcggtatagtgtcggcaggaaagaaccttcacatcccgccgtaattcggcccgctcgcgccttcggggcaaatccaagtgatgttttgcgtcgggtctttgatgtcgcaggttttgcagtgcacgcagtttgccgcgttgatttgcaggcgcggattgccgttttcttcaacaatttcgtacacgccggccggacaatagcgcgtttcgggcgaggcgtattctttgtagttcacgtctatcatcgtttgcggattgttcagcaccaaatggtcgggctggttttcttcgtgcgcgagattggcaaggaagacgctgctcaagcggtcgaaggtcaacacgccgtcgggtttcggataatcaatcggcttacacgcggcggcttttttaagctgctcgttgtctttgccgtgatgtttcaaggtccacggggctttgcctctgaaaatcatctgatcgatgccggtgtagattgagccgaggtaaacgccccatttgaatgacggacggacattgcgcgcggcgtaaagctcttgatacagccagctttgttcaaaacgttgctgataatccgccgcctctttgccgctgtcgaaaccctccacttcttcaaggttttccaacaaggggaacacggcttcggcggcgagcatggcggatttcatcgcggtatgaatgcctttgatgcgcggcatattgaggaaacccgccgcatcgccgaccaaaatgccgcctttgaacgagagcttcggcaaactttgcaaaccgccttcaatcagcgaacgcgcgccgtaagcaatgcggcggccgccttcaaaggttttgcggatttcgggatgggttttgaaacgttggaactcttcaaacggcgacagataaggattttgatagtccaaaccgaccacgaagccgacggcgactttgttgtcgtcgaaatggtaaacaaacgcgccgccgtaggttttgctgtccagcggccagcctgcgctgtgcaccaccaaaccgggctgatgctgttcggacggcacttcccaaacttctttaatgcccaagccgtaagtttgcggctggctgttttggtcgagttggaaacgttcgatgatttgtttggaaagcgaaccgcgacaaccttcggcaaacagggtttgctgcgcccaaagctccatgccgggttggaatgaatcggtcggctcgccgtctttgccaatgcccatattgccggttgcaatgcctttgaccgaaccgtcttcgtgatacagcacttcggcggcggcaaagcccggatagatttccacgcccatattttccgcctgctccgccaaccagcgcacgacttcgcccaagctgacgatgtagttgccgtgattgtcgaaattcggggtaatcggcaggttgaacgcttttttctcggtcaggaacaacactttgtcctgcgttactgtgcgtgtcagcggtgcgcctttttctttccagtcggaaatcaactcattcagcgcaatcggatcgataactgcgccagccagcgaatgcgcccccacctccgaacctttctccaccacgcaaacgctgatttcgcgcccgttttgttcggcaagctgcttgagtttgatggcggcagacaaacccgacgggcctgcgccgacaatcacgacatcgtattgcatactgtcgcgggtgatggattctgtcatggcggttcctgtgtatttattattgaattgcaaatccgtaattatacaacgggaacatatagttaccaaatacaacaaaggtcgtctgaaaaccatattttcggttttcagacgacctttgtcgaaatttcaataagcacgccaccattttacctgtccgaccgcaaactccgtctgacgtttcggactgcgtgtgaaaaacgccttatccccgccggcatccctccctttcggcacaaccgccaaaatcttacctgccaaatttccctcacgggtttgccaagcatccaaaaactgcgccctgctcattgaaacatgacccagcgacgggtcggcaagcaaaaccgtattgccgtctataccgcgcaataccgagaaatgatcatccttgcggtatttcagatacacgatgacggggatttgcaactgtgcaagctgctcgaaagacagggcatagcctttcgcttcaaaacccaaatcaggcataatgcgccgcatatcctcaaacgacgcgggcatctgctccttatccagtttttttaacacgtcctcttccgtcagcttttgcccgtaaaaattgttcaaaagcgtcaccaccgaagccgccccgcaggaaaaatccaaatcctgctttacaatattgaaatcgcgcctttctttccaactctgcactttgatttttccataagcaacaggattatagtggattaaatttaaaccagtacggcgttgcctcgccttgccgtactatctgtactgtctgcggcttcgtcgccttgtcctgatttttgttaatccactataggtttccgtgcggacgtgttcagattcccgccttcgctggaatgacggcggagcgatttctacttttccgataaatgaccgtaacttaaaatcccgtcatccccacgaaagcaaaaatcccgcctgtcggatttcggtttttttgggcgtttcgggaaacttataaatcgtcattcccgcgcaggcgggaatccggtttgctcggtttcggtttttcgggcgtttcgggaaactgatgaatcgtcattcccgcgcaggcgggaatctagaacgcgggacggcggcaatattcaaaggttgtctgaaaattcagaggttctagattcccactttcgtggggatgacgggatataggtttccctacggacgtgttcagattcccgctttcgcgggaatgacggcggagcgatttctacttttccgataaatgaccgtaacttaaaatcccgtcatccccacgaaagcaaaaatcctgcctgtcggatttcggtttttttcgggcgtttcgggaaactgatgaatcgtcattcccgcgcaggcgggaatctagaacgcgggacggcggcaatattcaaaggttgtctgaaaattcagaggttctagattcccactttcgtgggaatgacgggatataggtttccctacggacgtgttcagattcccgctttcgcgggaatgacggcggagcgatttctgcttttccgataaatgaccgcaacctaaaccccatccttcccgcaaaaacagaaaaacaaaaacctaaaatcccgtcatccccacgataacagttgcgtaattgcgtagagtgggcttcagcccaccgttttttctttttcggtcgttgattggtgggctgaagcccacccttgtatatcggaactcccgtatcatagcaacaaaccgcccggccgccacccgcgcccacccaaggcacacaaccgttgcgtagcacagggagcggcagggcaacccatcgacacaaccggacagttgccggacaacacaaccgaatgtaaggcaggttgatgatgagtacccgataccattacgcaggtatagtgaattaaatctaaggggctgtactagattagccctaaattccacaccaatcccgcaggattttaagctgttgagacggtgtgccgaagttaaatcgaaattcgcattctttcaagaacagcgggaaagatttacgatcgattccgttgtattttcgcaagacgcgttttgcctgattccaaaagttctcaatgccgttaatgtggttctgacggtctgcacactccttggaatggttgatgcggtaatggataaaaccgctcacgtccaacttgtcgtagctgctcagactatcggtataaacaatactatccggcatgattttctttttgatgacagggagtaacgtttcagacttggcattatccaccacaacggtatagacccgtccgttgcgtttcagaatgccgaaaacaaccacttttcctgccgcaccgcgaccacgtctgcctttacgccgtccgccgaaatcgctttcgtccggctcgacagggccctcaaaaacctcatcggcagccaaggccaaatgatggttgataaccgtgcggattttacggtagaacagtgctgccgaattgggatggatacccaaaatatcggcggcagaacgggcggtaacttccagtacaaaaaacggagcagttctttctgtacttttttctttaatttgcagtgcgttatcttcatatttcgagggtaacatatctgctaatctagtacagccccaaaaatataccaaaaacagcaaaacaaattgtaaggatacgtataggctttgtaaaggtaaattgtgaaaaaagcagttttttaaacgaatgaaacggcttcgggctgaaatatatgctgatgccctgttcttcccgtatttctcgtgtgttgtcaaagtgcaggctgctttgaaatcggtattgccatctatgaaccaccactttgctttatttcagcgggcttgagatgtgtataagaatattgttttgaataaatttaaagaaaatgataatcgttattgacgatttttaaaggaaagcgtagagtgccaattctatgaagcaatacggtaagtaacaatgaaaatatctactgcttgggtatagagcatatttcacaacccgtaactattcttgcggaaacagagaaaaaagtttctcttctatcttggataaatatatttaccctcagtttagttaagtattggaatttatacctaagtagtaaaagttagtaaattatttttaactaaagagttagtatctaccataatatattctttaactaatttctaggcttgaaattatgagaccatatgctactactatttatcaactttttattttgtttattgggagtgtttttactatgacctcatgtgaacctgtgaatgaaaagacagatcaaaaagcagtaagtgcgcaacaggctaaagaacaaaccagtttcaacaatcccgagccaatgacaggatttgaacatacggttacatttgattttcagggcaccaaaatggttatcccctatggctatcttgcacggtatacgcaagacaatgccacaaaatggctttccgacacgccagggcaggatgcttactccattaatttgatagagattagcgtctattacaaaaaaaccgaccaaggctgggttcttgagccatacaaccagcaaaacaaagcgcactttatccaatttctacgcgacggtttggatagcgtggacgatattgttatccgaaaagatgcgtgtagtttaagcacgactatgggagaaagattgcttacttacggggttaaaaaaatgccatctgcctatcctgaatacgaggcttatgaagataaaagacatattcctgaaaatccatattttcatgaattttactatattaaaaaaggagaaaatccggcgattattactcattggaataatcgagtaaaccaggctgaagaagataattatagcactagcgtaggttcctgtattaacggtttcacggtacagtattacccgtttattcgggaaaagcagcagctcacacagcaggagttggtaggttatcaccaacaagtagagcaattggtacagagttttgtaaacaattcaagtaaaaaataatttaaaggatcttattatgaatgagggtgaagttgttttaacaccagaacaaatccaaaccttgcgtggttatgcttcccgtggcgatacctatggcggttggcgttatttggctaatttgggtgaccgttatgcggatgatgctgctgcaattgtcggtaaggatgcaaacttaaatggtttgaatttatggatgaaaaaaggtgtggaaaacctatgggatgatacggtcggtaaaaagacccgtttagagaaatttgatcgggttgcattgcaacatttcagccaatatgtagatctaattaatgaaaataatggtagattacctaacactagtgaaattgagagaagttactataaagccgttaccgaaaatggtgtttcttctagtgcagctattgatttagttattaatcgctcacttccggatatggcagatggttattgggcattaggtttggggatagaagccgaacgtatccacaatgagcaagcagtaaataatccgaacggtagcgaaagggataatagaaagcagttaatatctgctttagataaaggatttgatggatcttttaaagagaagcattttacttttttacaatctgtgataatggatgtaacaaagttaggtgttgaatatacaatagatggttggcaaaaaattggaggttggggtaatgggataatcaatgatttatataaaagtgttgtaaaaagagagtggactggaatatttgagatcgttaataataacatcaagcaatttagagatctgttcccaaatccggaaggctggatcgatgatggtcaccaatgtttcgctccttgggttaaagaaactaaaaaacgcaatggcaaatatcatgtctacgacccccttgccctagatttggacggagacggcatagaaactgtcgctgccaaaggcttttcaggcagcttatttgatcacaccaacaacggtatccgcaccgccaccggttgggtttctgccgatgacggtctgcttgtgcgcgatttgaacggcaacggcatcatcgacaacggtgcggaactcttcggcgacaataccaaactggcagacggttcttttgccaaacacggctacgcggctttggccgaattggattcaaacggcgacaacatcatcaacgcggcagacgccgcattccaatccctgcgtgtatggcaggatctcaaccaggacggcatttcccaagctaatgaattgcgtacccttgaagaattgggtatccaatctttggatctcgcctataaagatgtaaataaaaatctcggtaacggtaacactttggctcagcaaggcagctataccaaaacagacggtacaaccgcaaaaatgggggatttacttttagcagccgacaatctgcacagccgcttcaaagacaaagtggaactcactgccgaacaggcaaaagccgccaatcttgcgggcattggccgtctgcgcgatttgcgcgaagctgccgcattgtccggcgatttggccaatatgctgaaagcttattctgccgccgaaactaaagaagcacagttggcattgttagataatttgattcacaaatgggcggaaaccgattcgaactggggcaaaaaatcgccaatgcgactttcaaccgattggacgcaaacggctaatgaaggtattgcactgacaccatcccaagtagcacaactaaaaaagaacgctttagtttccctttctgataaagctaaagcagctattgacgccgcccgcgaccgcattgccgtgcttgatgcctacacggggcaggattccaacacactctattacatgagcgaggaagatgcgcttaatatcgtcaaagtaaccaacgatacatacgaccatctcgccaaaaacatctaccaaaacctgttgttccaaacccgtttgcagccatatttgaatcaaatcagtttcaaaatggaaaatgatacgttcactttggattttagtggtcttgttcaagcatttaaccatgtcaaagaaactaatccgcaaaaagcttttgtggatttggccgagatgcttgcatatggcgaacttcgttcttggtatgaaggccgaagactaatgaccgattatgtggaggaggcaaaaaaagcaggtaaatttgaagattaccagaaagtgttgggtcaggagaccgttgcattattagctaaaacatcgggtacgcaagcagatgatatcctgcaaaatgtaggctttggtcataataaaaatgtttctttatatggtaatgacggcaacgacactctaatcggcggcgccggtaatgactatttggagggcggcagcggttcggatacttatgtcttcggcgaaggcttcggtcaggatacggtctataattacgactacgctaccggacgcaaagacatcatccgctttaccgacggtattacagccgatatgctgacttttacccgagagggcaaccatcttcttatcaaggcaaaagacggcagtggacaagttactg

SEQ ID NO: 37808 - DNA, 7800 bp, Neisseria meningitidis
cctcgtaaaagttccatgctttttcatggaaatagaaaacgacggtgttgattaggggttcgaccagcgcaactgctcccgatacgcctatactgcccgtcagtacataggttacactgaaggcgacgctgaaatgcagtgcggcaaaagtcagggttttaagcatcatcctctcccggattggacattgacggagagatgataaagattatcataaggctgcgcggtttaaatttgctatttgttgttagtgtagataaatcgttttttaaataaggataggaattatgaatcataaaaagatcgttgttttggatgcggatactttgcccggccgggtttttcattttgattttccgcacgagcttgcggtttacggtacgacaggtgcggatgaaacggcagaacgggtgcgcgatgcacatattgtcattactaacaaagtgatgatttctgccgatattattgcggctaatccgcagttggagctgattgccgtcagtgcgaccggcgtgaacaatgtcgatattggggcggcgaaggcggccggtgttgcggtatgcaatgtccgcgcatacggaaacgaatcggttgcggaacacgcctttatgctgatgattgcgttaatgcggaatttgcctgcctatcagcgtgatgttgcggcaggattgtgggaaaagtcgccgtttttctgccattacggcgcgccgattcgggatttgaacggcaaaacgctggcggttttcggacgcggcaatatcggacggacgcttgccggatacgcgcaggcattcggtatgggggtggtgtttgccgaacacaaacacgcgtccgctgtgcgtgaaggctatgtttcctttgaagatgcggtacgggctgctgatgtgttgtcgctgcactgtccgctaaacgcccaaactgaaaatatgataggcgaaaacgaattgcggcagatgaagcctggcgcggttttaatcaattgtgggcgcggcgggctggtggatgaaaacgcgctgcttgccgcactcaaatacgggcagatcggtggggcaggtgtcgatgttttgacgaatgagccgcccaaaaacggcaatcccttgctgaatgcacgattacccaatctgattgttacgccgcataccgcgtgggcaagtcgtgaggctttggacaggctgtttgatatattgttggcgaacattcacgcctttgtgaaaggagaggcgcaaaaccgcgtggtttgaacctgtcgggattgcggaaaaaaatgccgtctgaacgcctcaagggttcagacggcatttcttgagattcccgtttaaccgactttgtcgcccggctgcgcgcctgtatccacatccaagagcttcagtttcccgtctgccgtggcggcactcaaaatcatgccttcagatacaccgaattttgccattttgcgcggggcgaagttggcgacggcgatgaccatgcggccgttcaattcggcagggttcgggtaagacgcggcgatgccggagaagatgatgcgtttttcaaaaccgaaatcgaggtcgaatttcaaaagtttggtgctgccttcgacagcttcgcagttcaatactttggcaacgcgcatgtcgattttcataaagtcgtcgaaactcgcctgttcggcgactttttcgtatttgccctcttcggcggcaggtgcggctgcggcggcgatgctttgtttgttggcttcgattaaatcgtccacttgtttttgctccactcgttgcattaaatgttcgtatttgttgatggcgtgtttgcccaaggtatcgcgtgtatttgcccaagtgatggcttccaaattcaggaatttggcggcgtttgcggcggtttgcggcaagacgggggcgaggtaggcggtcaacatggtgaaggcgttgatgagttcgctgcatacttcgtgcaggcgttcgtcttggccttcttgtttggcgagttcccacggcttgttggcatcaacgtattcgttgacaatgtctgccaaggccatgatgtcgcgcagggctttggcgtattcgcggctttcgtagcattcggcaatggcttcgctttgcgcagtcagttttgccagcaattcgctgtcggcaacatctttcagacggccttcaaagcgtttggcgatgaaacctgaggcgcgggcggcgatgttgacgtatttgccgacgaggtcgctgtttacgcggctgataaagtcttgcaggttcaaatcgatgtcttcgattttgctgttgagtttggcggcgatgtagtagcgcatccactcggggttcaggccttgttccagataggatttggcggtaataaacgtgccgcgcgatttggacattttttgtccgtcgacggtcaaaaagccgtgtgcgtacacgccggtcggggcgcggtggccggagaaatgcagcatagcgggccagaacagggcgtggaaatagagaatatctttgccgatgaagtggtacatctcggtttggctgtcggctttgaagtattcgtcaaaatcgacgccgatgcggtcgcacaggtttttaaacgacgccatgtagccgacgggcgcgtccagccagacgtagaagtatttgcccggcgcgtcggggatttcaaaaccgaaatacggcgcgtcgcgggaaatatcccagtcggacagggtggtttcttcaccttcgcccagccattctttcattttgttgagggcttcggcttgcagatggggcttgccgtcgtgcgggttgttgccggaagtccatgctttgaggaagtcggcgcattcgcccagtttgaagaagaagtgttcggattcgcgcaattcgggtttcgtaccggaaacggcggaatacgggttaatcagttcggtcggggaataggtcgtgccgcagacttcgcagttgtcgccgtattggtcttgggcgtggcatttcgggcattcgcctttgacgaagcggtcgggcaggaacatttgtttttcggggtcgaaaagctgctcgatgacgcggctctcaatcttgccgttggctttcagcgcgcggtaaatgtcttgggaaaactgtttgttttcaggggaatgggtgctgtaataattgtcgtaaccgatgaaaaagccagtaaagtcggcgaggtgctcttcgcgcactttggcaatcatgtcttcgggcgcgataccttgtttttgcgcggcaagcattacgggcgtgccgtgggtgtcgtcggcgcagcagtagtggcacgcgtggccgcgcagtttttgaaagcgcacccaaacgtcggtttggatgtgttcgaccatgtggccgaggtggatgctgccgttggcatagggcagggcggaggtaactaagattttgcgtgtcatattgtgctttgcaaacaatgggtaaaggcggattataccgcaaatcaaacggggaaatgccgtctgaagcctgaaaaatcgggcttcagacggcatttttgccaaccggcgggagttattcgacggttacggatttcgccaggttgcgcggcttgtccacatcggtaccgcgtgcgagggcggtgtggtaggcgaggagctgcacggggatagtatgcacgacgggggacagtttgccgacgtggcgcggtgcgcggataacgtgcacaccttcggtggcattaaaattgctgtcgaggtcggcaaagacgaaaagttcgccgccgcgcgcgccgacttcctgcatattggctttgactttgtccaacaggctgtcgttgggtgcgatgacgacgacgggcatattttcgtccaccagggcaagcggcccgtgcttcagttcgccggcaggataggcttcggcgtggatgtaggtgatttccttcagcttcaacgcaccttcgagggcaatcgggtaatggatgccgcgccctaaaaacagcgcgctggttttcttggcaaactgttgcgcccatgcggcaatttgaggttcgaggttcagagcgtgctgcacgctgccgggaagctggcggagttcttcggtgtaacgcgcttcgtcttcttcggaaaccaaaccgcgcactttcgccagcgttaccgccaaaccgaacagcgcaaccagttgcgtggtaaacgctttggtcgaggcgacgccgatttccgcaccggcacgggtataaagcacgaggctgctttcgcgcggcagggcggattccatcacgttgcaaatggagaggctgtggcggtgtcccaaggatttggcgtatttcaacgcctccatcgtgtccagcgtttcgccggattgggaaatggtaatgaccagttggtcggaatcagcaatcacgctgcggtatcggtattcgctggcgatttcgacgtcggacgggatttttgcgatggattccaaccaatatttggcggtcagcgcggcgtaataggacgtgccgcaggcaaggattttgacgctgcggatgctttcaaacacgcttttggcatctttgccgaagttttcggggatgaagccgccgtcgaggaaaacctccgccgtgtctgcaatcgcgcggggctgctcgtggatttctttttgcataaagtggctgtacagtcccagttccaaagaggcgagcgagagttcggataccttgactttgcgttcggcaggcaggccgtttttatcggtcagccttttgatgccgtctgaagccagcagcgcgatgtcgccgtcttcgaggtacgccacgcggcgcgtaaaggcgatgacggcggatacgtccgaagcgataaaggtttcatcgtcgcccaaagcgaccaaaagcgggcagcccatacgcgccacaactaattcatcaggcttgtcttgggcaataaccgcgatggcgtatgcgccgtggaaacgtttgaccgcttcttgtaccgcttcaaacagcctgccgccgttttgcgcgtattcgtgattgatgctgtgtgcgatgacttcggtatccgtttgcgattcaaaacggtatcccaaaccttccaaacgtttgcgttcgctttcaaagttttcgatgatgccgttgtgtacgaccgcaatcataccgccgctgatgtgcgggtgggcgttcggctcagtaacgccgccgtgtgtcgcccaacgcgtatgtccgatgccgatgccgccgctgatgcctttttcgcgtgccgcgtcctccataagctgcacgcgtccgacgcggcgcacacgtttgattttgccgtcggtgttgacggcaatgcctgatgagtcataaccccggtattcgaggcgtttgagaccgtcggtcagaaaatcgacgacgttgtgatgggcgcggatggcgccgacgataccgcacataactgttccttagtatccggttgaaaaaaaacaggcgcggacggcttccgtgccgcaccttcctcttcggattataaaccgcctcccgcgccggaaaacagcaaaatgccgtctgaaggcttgggcttgctcaaaaaaaggagggatttccctgtttatccaggatgggcgttcagacggcattacctgctgctggtttatagtttttgcaaatcaacattgacaagctgaaaaaaaaaaacaatatactcgctcggtcttaatgttaacggagtatggaaatgaaacaaatgcttttagccgtcggcgtggtggcggtgttggcgggctgcggcaaggatgccggcggttacgagggttattggcgcgaaaagtcggacaaaaaagagggtatgattgccgtcaaaaaagaaaaaggcaattacttccttaataaaatccacgtggttacaggcaaggaagagtccttgcttttgtctgaaaaagacggcgcgctttcgataaacacagggataggggaaatcccgatcaaactttccgacgacgggaaagagctgtatgtcgaacgtaggcagtatgtcaaaaccgatgcggcgatgaaggacaaaatcatcgcccatcagaaaaagtgcggacaaacagcacaggcataccgcgacgcgcgaaatgcgttgccgtcaaaccagacgtatcagcagcatctggcggcgatcgagcaattgaaacggcggtttgaagccgagtttgacgaattggaaaaagaaatcaaatgcaacggcagaagcccggcattgttgctttagtaggggacaaccgggaggatgccgccgtccgaatcggatgtgcggtttctgtaccggtacgggcgggcaggaatgtccgccttttttgttcggatgcgtttgaatacccgtttgattccgaccgtttgcaaggggtatttccgttcgggcggaaattatagtggattaacaaaaaccagtacggcgttgcctcgccttagctcaaagagaacgattctctaaggtgctcaagcaccaagtgaatcggttccgtactatttgtactgtctgcggcttcgtcgccttgtcctgatttaaatttgatccactataattccgtcaaataagaaaggaattttgtgcctgcggtatcgcaaaacttcgccttaatgcgcccgattgcctagggatgggcttcagatggcattgttttccggtttacgggcggtattcgggcttcataccgttgggtaggagctgccagacatatcccgtggttttctgtttgccggcaagttcgccggcttcgtcgccgtatccccaaaaataatccacgcgcaccgcgcctttaatcgcgctgccggtatcctgcgccataatcaggcggttgagggctttgcgggtaaccggatgggcggtggcgacaaataagggcgcacccaaggtaatgtagtgccggtcgactgcgccggcatattcccccatcagcggcgtgcccagtgcgccgacagggccgtcattgctgcttccggcaagctcgcggaaaaagatatagctggggttttgacccaaaacttcggcgaggcgttgcggattttgccgcatataagacttaatgccctgcatggaggtttgtccgagtttgaggtagcccttatccgccatatagcgtccgatggaaacgtagggatgttcgtttttgtcggcatagccgatgcggatgtatttgccggacggggttttcagacggcccgagccttggatgtgcataaaaaaaagttcgacagggtcttcggcgtaaccgagtatcggggctttgccgtcaagcgcgccgccgttgatttggttgcgcgtgtggtaggggaggaagcggcttccttcaaacctgcctttgattgctgttgtgcgcgcggtgatggggaatcgggagaggtcggcggtatgtgtgccgccggtattgtcgattgtgccgctgttttttcccgtctgcctgatgcggacaagggcttttccgctccgcaaaccggcaggcagggggacggagataaaatcgtcgggaataccgtaaatcgggaagcgggcttgtgccgtccgcctgtcgtcgcccttcagcaccggttcgtaatagccggtaaccgtaccggcaaggcttccgttgcctgcaacctgccacggcgtgaaatagcgttcaaaaaactgttttgcctgaaaggaatggacgggggtttgaaaggcttgggcgcacacatcctgccagccttggcggtttttcaaattggcgcagccgaggcggaaggattgcaggcttttggcgaaatcctgcgccgcccagtggggcagggacaggtgcggtacaacggtatagacggccccgccgccgccgaccgtcgttccggcggggtcggggatgccgaccggccggtccgggccgttgatgacggatgtgtcgggttgcggaaaggtttggatgc

SEQ ID NO: 37809 - DNA, 29069 bp, Neisseria meningitidis
  misc_feature (28994)..(28994): N is any nucleotide
ccgggttaagaaattgtacaagcggacaaaatatttaatgggtatcaaagaatgacctaccgtgaattagttgaacgtcagttggctgtgcgccatgccgatttggaattgggcttaagccgcgcacgcgagcaagagccgtttgtcattcatgtttccgatctgttggataaggcaggcattgagtacgcggtacgcatggataaggattttcagacgacgtttcaccttgaatatccaattacgaactatgacacctttaaacgtgcggtttggcaaactttgggggcgtattactgtgtttgtaatgatggtgatggactggagattgccagcaatcgccctgacggttacgccgtccgtatcgtattcggcgatgtgccggtttaaaggggttttaaatggactttgaatttggtttcagaaccctgtggccgattgcgacggcggcattttggttttgggtcaacggcatttcaggccgcctgaaagaggcggacaagcgtatcgacgaccttaaagaggagttgcacgcggtcaagctctcttatcacaccaaggcggacgccaaggcagacagcactaatattgcggcggccttggagcgaattgaaaacaagttagaaaaagtaaacgaaaaactggacaggaaagcagacaaatcatgagcgacccgattttggatgccttggcgcgtattgaaaacaagactgatcaaacgctgaaaaatcagaaggaaatgcaggcggaaattgcgcaaattcgccaagacacgaaacgcacggccattacattcggcgcactgggcggcggcgtgattacggtcggctgggaattgcttaaagcgaaaatgggactgtaattatggctcacccgcaagaaatccgtgaaaagttacgccggctctatgtgagcggcgagcaaactttggaaacggcggccttgatgtgcgaaatcccgcagaccactgcgcgtgcgtggaaacgtgcggataaggaaaaaggcgacgactgggataagatgcgcgccgcttacactttggccggtggcggtattgaggatttgagccgtgcgatgttggccggttttatggtgcagtacaacagcacgatgacgatgctgcaggattcgagtaccgaagatttgccaccatccgaccgcgccaagctgttggccagcctggccgatgcgtttacgaaaaccgtatcggccaatgcgcgtgtgatgccggaaacgtcaaaactggcgacggctttggaattgattgagttcttgatggcgtttgtacaagaaaaacatcccaaacatttgcctgcctttgtggaggtattggagccgtttggggtggaagtggagaagaagtttggttagaggccaacaaatttttttaaaagagtaatgagggtggcggcagggatagcattaattgcattttccgtaagcgtacttaatgcagtgtccttgattttccctaattcttttttcaaccagcttttttctgaatcagaaatctctgcttggtctatttttgccgcaattaaagcctgaatagtgtcgctgtgtagtttgactgtgacaacaccaagaatggcggataggccgccatcatcggtaaggaagtctatgcccttatgattaattttgcagtcaaaatttttatgaagtgaatctatcgaagtaatttcaattaaaccagattcttctaagtaataaatattttttaaaaaatattggaattcatctgattgtaaagttgctaggtgttgactttgaatttcacaaccaagagtcaaagccaagcccaatccttgtttatcaacagggatgttagaagtaataggtaaagaactactagggaaaagagagttatacaccttggttgcttttaggcagttcgggtaattatcacttaaaactcgtaagattttttcctgaatacctctatttaaccagttcataaattattcctcatgaaaacaaaagaattcctcaaatcccttgccgaactggccgccagtttgcgccaagtcatcgaagcggaagtggacggcttcgatgcgtcgcccaaggctattgctgcacgccgtgccaaggtgtttgacccggtaggcggttacgagtatttcgtgaatacctacttcccccattatatccgctcgcctgagaaatccgaactgcatgcgtttttattcagccgtctgccggagattatccgctcccccaaaggggaaaatgaggcggtgggtgcgccgcgtggagagggtaagtcgacgaaggttactcagttgtttacgctgtggtgtattgtgaccggccaaaaacattatgctgttattgtgatggacagtatcgaccaggcatatccgatgctggaagccatcaaggcggaacttgaatttaacccgcgcttgaaaaccgactttccggaagtatgcgggcagggccgtgtatggcaggccggtacgattgtgacggccaatgacgttaaagtccaagtggccggtagcggtaaaaagctgcgcggtttgcgtcacggcccttaccgtcctgacttaactgttttggacgatattgagaatgacgagcaagtccgcaaccccgaacagcgcgacaagctcaatgcgtggctgactaagaccgtattgcctctgggcggtgtcggtcagaaatacgatgtgatttatatcggcacgattttgcattacgacagcgtacttaaccgcactttgaataacccgttttggcacggtattaagtttaaggcgatgaaacgctggcctgaccgcatggatttgtgggacaggtgggaggaacttttccgaaacgacggcgagacggtggccgaggcgttttatcaggcaaacaaagacgagatggagcgcggcgcggtcacttcttgggcggcgcgtggcgtactcgcgctgatgaaaatccgtgcgcgtgacggccatgcgacgtttgattcagaatatcaaaacgatccggtcagtggcgaagatgcgccgtttgccaagtcgatgaagttttggaacgacctgccgtccgatttggtgtatttcggtgcgctcgacccgtcactcggaaaggccggggcgagccgtgacccgtccgcgattatcattggcggttatcaacgtgtaaccggcaaactgtatgtcgtggaggctcagattaaaaaacgtctccctgatttgattattgaggacgttattcgattgcaccgtcaatatcgttgcaaactgtggtttgttgagactgttcaatttcaggaatttctgaaagacgagctggtcaagcgcagcgcggcgcgtggaatacctgtcccagcgcgggcggtcaaaccggtatcggacaagctgttgcggatcgagactttacagcctcacatggcgaacggtttgattctgttgaatgagagccaacaaacgctgatacagcagttccgccattttccaaaggctgatcatgatgatggtcctgatgccgtgcatatgctctggtcgggggcggtggccaattgtgtgccgatagaatggcaaagccctaccgataacgattttgatgacgagataaaaagtaaatggagccgataatggcaaaaaagaacaataaaactaaaatccaaaagcccgaagctgcattgcagacggacgtggctcaaattacggcgaccggtcgggttatcgccgagcatccgtccaattttattacgccgcaaaagatgcgggccctcttcgaggacgcagaaagcggcgacatccgcgcccaacacgagcttttcgcggacattgaggagcgcgacagcgacatcgcggcaaatatggggacgcgcaaacgcgcgctgctgacgctcaactggcgcgtcgccccgccgcgaaatgcgacgcccgaagaagaaaagctgtccgaccaagcctacgaaatgatggacagcctgcctaccctcgaagacctgattatggatttgatggacgcggtagggcacggattttctgcgttggaggtcgagtgggtattttcagacggcctttacctaccccgaaactttatccaccgcccgcaaagctggttcaaatgggacaaagacaacgggctgctgctgcgtacccgcgaaaatccggaaggcgaagcgttgtggccgctgggctgggtcgttcatacccaaaaatcgcgcagcgtccagcaggcgcgcaacgggcttttccgcacgctttcctggctgtatatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtcacaacgcggcaggcatcatgccagaaggtatggaaatagagctccacaacgcggcaaacggtacgacggcaaccagcaatccgtttttgcagatggccgactggtgcgaaaaatcggcggcgcggctgattttggggcaaacgctgaccagcggtgcggacggaaaatccagcaccaacgcgctgggcaatatccacaacgaggtacgccgcgatttgctggtgtcggacgcaaaacaggtggcgcaaaccatcacaagccaaatcatcggaccgttcctgcaaatcaactatccccatgccgacccaaaccgcgtgccgaaatttgaatttgacacgcgcgagccgaaagacatcgcggtctttgccgacgctatcccgaaactggtggatgtcggcgtacaaatccccgaaagctgggtgcgcgacaaactggtcattccagatgtgcaggagggtgaggctgtgttggtgcggcaggtaccggacaatccggtaaacagaactgcattggcggctttatccgcccacaccgtaccatctaaggctacgggcaggcatcaggaaatattggacggcgcgttggatgacgcgctggttgagcccgatttcaattctcagctcaacccgatggtgcgtcaggcggttgccgcacttaatgcttgcaacagctacgaggaggcagatgccgcactgaatgcgctttatccgaatttggacaacgcgaaactgcgtacctatatgcagcaggccttgtttatcagcgatattttgggacaagaccatgcccgcgcctgatttgggatttgccttaagtctgccgccaaaaaaggcaatcgagtggctggaaagtaaaaaggttacggcggagagctaccgcaatctgacagcctccgaaattgccaaagtctatacgattgcccgcatgaccgacttggatatgctcaacgacatcaaaacttcgatggttgaatcggcaaaaagtggacagtcgtttgacgattggcgaaaaggtatcttgaatctgctcagcaacaagggctggctgcatccgaacgggcataacggtaaggatatcatcgacccagccaccggcgaggtattcggttcgccgcggaggttggagacgatttaccgtaccaatatgcaaactgcctacaacgccggtcaatatcaaggatatatggcaaatattgatgcacgaccttattggatgtatgacgcggtaggcgacagccgcacccgtccggcgcattcggcaatagacgggctggtgtaccgctacgacgacccgttttgggcaacgttttacccgcccaacggctacaactgccgctgctcggtcatcgcgctgtcggagcgggatgtggaacgccaggggcggattgttgggcaaagcacggcggacaatctggtcgagacccataaaatctacaacaaaaaaggcgatacttatctgacccttgcctataaagcaccggatggcagtctgtacacgaccgatcgaggatttgattacaacgccggacgaatgaactaccgccccgatttagacaagtacgaccgtgcgttggcgcatcaatttgccaaagcggaaatgggtggtgcggattttaaaaccagctttaaacagcttgaaaaagagttttatgaagtcaagcaacgtttggatattgatggcaagcccgataaagagcagaaaatcaaaatccgaaatgcgctatcaagacagcttaaatttgctgcgggtgtattgagcaaggaaacgcaagaattggcaggtatgacacgagcgacggtgtggctgtctgatgatacgttggttaaacaggtagacagccgtgaggggcagaatttcgatgactcctactatgcttttttgccggatatgctgcaaaaccctgaacatgtcatccgcgacaatcgtgaattgattttcacagctcgctataaaggctcggcattgtgggcagttttaaaatatattaaggaggtggatgagatttatctacagtcgtaccgaatcagtaacgacaaagagattgccaaatttatggcgaagaagaaagtattgaaatagacgttgggcaaggctcgaaatcacttgcacacgctctcggacgccctaacgggcaggctgcggtatcgaggttatcaccgcttttccaacgtctgtacggaataataccatgattgatgtcaaaatagacaatatctttgtcgtcctaaaccaaatcgagcggcttggcaacgggatcgaaaaccgctacctgctgatgcgccgactgtccgaaaccatgcacacggcggtcaagctcaatttccgctacgcaggccgtccgaaatggttgggctaaaataccgcgacggcaagccgctttcggattcgggtcgtctgaaagacagtttttccacactgtcagacaacgatacagcccttgtcggtacgaatatcgtctatgccgccatccacaacttcggcggtatggcggggcgcaaccgcaaagttcggattccgcaacgggaatttttgacgctgacggacgacgacaaacaggctttgatggacgatgtgcaggattatttttcgggtctgataccgtgaatttataaaaccctcaaaaacgcgctttttagcgcgtttttttatgcgggtaatacaaacccctgcccaagatataaaaatcaatcctagacgcttctaaaaagcccctgaaaacgattaattgtgtatcgcgcggacaggttttaaaaaaatggcgggagggtttgaagcacgcctactctttgttgttttttcaaataggcaaaatgaccgtattgagagaggtacacatgtccaaaaatgcacaaaaaaccctacttgccgtgtgcagtttcgaggtgcagccaaaagacgggcgaatccaactgctgccatatggcgaatttcgcgcagtagacggtcgtccgactgatgtccctgcgtggtatctgaccgaagaaaacggtcatgatgtcgcgttgttggccaacagctcgcgcaatcagttggttgtcgattatgaacaccagacgctctacaaagagaaaaacggacaacctgcacctgccgccggttggatgcgttggctggagttcacgcctaaaggcatgtttgccgaagtggagtggacggacaaggcggctgcggcaattgccgcaaaagagtatcgctacatctctgctgtgttttcctatgacacaaagggatatgtaagcaaaatttttcacgccgcgctgacaaatttccccgcgttggacggtatggacgaggtgctggcggcagcgtcggcgcaaattttaaaaccggaaacggagcaaaaccctatgaaagagttgttacagcaactgttcgacctgcctgatgcgggcgaagaagaactgaaggcggcattgtccgcgctcgtggaagccaagccgaaagacgtggcattgtctgccgacgtgttcgcgcagctggcggaaaaagacagccgcatcgcggcattgacggcgcaaaccgccaagcctgatttgactaaatacgcgcctatctcagtggttcaagagctgcaaagcaaagtcgccgcgctgactgccaagcaggaagcagacaaaggcaacgaattgattaccgccgcgctgacttcaggcaaattgctgcctgctcagaaggagtgggcaaaaggcgtattgaaacagccgggcggcttggcatttttgaccggctttattgaaaacgcccagccggtcgctgcactggcaggctcgcaaacgggcggcaaagcacccgacgaacgcgtcgccgcactgactgcggaagaggcagccgcagcaaaaatgctgggcatgtccggcgaagaatttgtaaaaatcaaagaaagcgaaggtaagtaatggacaaatcagcgattttgaccgcaatcacggcagcattccgcaaagaatttcaaacggccttggattcggatttcaagtgcaacactaaggtaccagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaaggrcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccttgggtcagttgcgtgtagctcatggcaatctttcttgcaggaaaggccgtatgctaccgcatactggcctttttctgttagggaaagttgcacttcaaatgcgaatccgccgccgtctgaaacaaggagtcatcatggcaaaaaccaacaacaaaccagaaaccgccgaaaccgccgccccgtcgtttgaagacatcaaagccgaattggacgccgtgcaggcagagcttgccgccgcccgaaacgatgtcgaaatgctgaccacagccttggaaaaagccgaagacgacaaaaaggcactgtccgccgaacttgccgaactcaaagtgcagcatacgcaacgtgccgccgacgctttggcggacagccgcgatgtgatgctcgtcagtaccggcgcagacggcaaagaattttggcgcggcggcctgctgtttgacggcggctggcgcgaagtgaagcgcgccgaagtcggcgaagcggtgtggaaggcaatctgcgccgagcctatgctgcaacgcaaggcggtcgagtaatggcatacgcgacggttgaggatatggttgcgcgtttcggtgagctggaagtcttgcagctcaccgaccgcaacaacgaggggctgattgaccgcgaggtcgcacaaaccgcgctggtggacgccactgccgaaatcgacgcgtatctggggcggttcagacgaccttttgaggatctgccgcccatcttggtgcgcctttgctgcgacattgcccgctaccgtctgacggcggctcagggcgtgttgattaccgacgaaatccgcaaccgctacaaaatcgacgtgctcgacctgctgcgtgctatggccaaaggcgaagtgcagctgggcgtggatgatagcggcgaagaagtggccgcgggcgaagacggtattgtgtttgtaaacggtaaaaataaggtgttcgggcgtgatcactgatattgagcaagcgataacagaccgtctgaaacggggcttgggtcgcatggtgcgcacggttaaaagctacaacggcgaggccgacgatttggcggggcaaatccatacgctgcctgcggtttgggtaacgtatggcggcagcaaagttgagcctgccagcaccggcggcgtatgcggacgttatcaggataccgccgaatttgtggtgatggtggcggcccgcaatctgcgcaacgagcaggcgcagcggcaaggcggcatcgacagccgcgaaatcggcagcaacgatttaatccgcgctgttcgccgcctgcttgacggccagcggctcggttttgccgatagccgcggcttggtgcccaaagcggtgcgcgcgattgccaatcatgtgctggtgcaaaacgccgcagtaagcatatatgcggttgagtatgccatccgctttaacacctgcgggttggaaaatgaccgctaccccgaacgcaccgacaatcccgacgaccccaaccatatctttaccaagtatcagggtacattgagcgagccgtggcctgatttcgaggggttggacggcaaaatttacgacccgcaatccgccgatgaaatacctgtaaacctaacccttaaggataagcaatgagcaaaatcaaagtaacggcggcagatggcctgcgtgtgccgaccgaacacaacccgcacgaatatatcggccaagagccggtggaggtggacggcaacagcctgtattaccgccgcatgattgatgacggcgatttggtggtggttgaggatgccgccccaaataccaaaacccgcaatactaagggagagtaatgatgccccatattgattttgacacgattccgggcagcatccgcgtgcccgggcagtatattgaatttaacacccgcaatgccgtacaaggtttgccgcaaaatccgcaaaaggtattgatggttgcacccatgctgaccgcgggcatacagcccgccttagagccggtgcaactatttagcgatgccgaggcggccgatttgttcggacaaggctcgctggcgcatttgatggtgcgccaagcatttgccaacaacccttatttggatttgaccgttatcggtattgccgaccacagcgcaggcgtgcaggcaaccgcaaccgttaccctttccggcacggccaccgcgccgggcgtggtggaaatcacgattggcggcaagcaggtaagcacggccgttaacaccggcgagaccgccgccacagtggcagaccgtctgaaaaccgccatcactgccgccgatgtaaccgttaccgcatccggcagcggcgcagccgttacgctgacggccaaacacaaaggcgagatcggcaacgagagcggcttaaccgtgagcaccggcaataccggcctaacttatcaagccaatgcctttaccggcggtgccaaaaatgcggacattgccacggccttgtccaaagtggcgggcaagcattatcacattatttgcagcccgtttagcgatgacgccaacgccaaagccttgagcaaccatattaccaacgtatccaacgccatcgagcagcgcggctgtatcggcgtattgggtatgagtgcggccttgagcacggccaccaccgctaccggcgaaatcaacgacggccgcatgacctgtgcttggtacaaaggtgcggtagagccaaacggcatcatcgccgcaggttatgcggcggtgttggcctttgaagaagaccctgccaagccgctgaacacgctggaaatcaaagggctggccgttacacctgatgcgcaatggccgctgtttgcagaatgcaacaatgcgctgtacaacggcttgaccccgctcacagtggtcaacaaccgcgtgcagattatgcgtgccgtatccacctataccaagtcggccaacaacaccgacgacccggcactactcgacattaccaccatccgcacgctggattatgtgcgccgcagcgttaaagagcgcattgccctgcgttttccgcgcgacaaattgagcgaccgcctgctgcccaaggttaagagcgagattttggacgtgctgattaagctcgaccaagccgaaatcatcgaaaacgccgaggccaacaaaggcaagctggtggtggcgcgtgcgcaaaacgaccccaaccgtgttaatgccattatccccgccgatgtggtcaacggcctgcacgtctttgccgggcgcattgatttgattttgtaacccttttcagacggcgtttaaaacaggtttaaaggccgtctgaaaccttaaaaaaggataaagcatgagcgacgctacctatgccgacgcggtgattatggagatgaacggccgcgatatcgagattgtgagcatcaagccgcaaaccactacaggccgcaagccggtcaaaacgatgaaccgcaacggccgagtcaacggttattgtgacggcgtaaccgaacacaaattaagcgttaccgccgccattccgatcgacggtacggaaatcgactgggacaacatcaccaaggcgaaaatcacgatttaccccatcaacgacgaagatcgccgcacttcctacctcgactgctttaccgtcgataccggcgagcaatatgaagtcgataacgaggcacgcatcgacattgagatgattgctttgcacaaaatcaaggagtaatgcgtgattaccgtcaaactgacccacgggctgacctacaatggcaaagtcgtatctgaattacgcctcaagccactgaccgtcggcggcgaactggcggcgttcgccctgattgatgacttgcccgagctgcccgaaaacgccacaaaagccgaactgctgcaacgcgacgtcctagagacgctgacctactggtcgcagcagattgaagcccaaggtatcccatccgacatcctgacggcgcagtggctgatggaaaacctctctaccgaagactaccataccgtgatggcggctcaggaggatttgcgcctaaaaccgtccgccgctacggcgagccccgatgcgccgtcggcggcggagcagtaaaacgcagctacctgacggcacacaaaagctaccgtcaggcggtcatcctgatggcaaggcggggataggggcggacgcagtgcgcgatatgtgccacgccgagctgtcggcatggtttgaagacatcctgtcgagcctgggcataaaaacgccgaaggaagagggagtgattgtgtcgaaacggctgagaaagccggagggaaaataaaaaggtcgtctgagtttcagacgaccttttttttatttgacggttagggttgttttctgccgattattgcaatggtgtttgtttctttttcaaaaacaacgctatataaaataccatctgccggaacgtctttttgcgctgttgctcctgtctgattggattctttgacgacttcggttaaagctgtaaaaagttgttttcctgcttccgattcgcccaatttgtctgtggtagttaaagacagaactgcctgaatactgtgtaatccatttatggcattattgactagattttgtcctttctctccgtcggtttttaaaatgtagcctactgagatagctctaattttttgctgctcgtccagtttgagcgcaatcgccccaaaatccattaccaaagtaaggtcataaccacaatcggtcttgacaatatttttattatggatttttgttgagacgttctgagttttaaatgcttgctccaaattgatgagatattgttcaactgtgatgtccattggggcggtacaatcagcagcctggatactttggacaggttcttcggcttgtgccgtttttgattgttggttgcaggctgataaaacaattgaaacacaaattgcggaaatcaattttttcatattcataaaatatccctttgaataaaatggttatcattctagtattataacgcaacaaacaaataaagcacgaaaacggggttgaagcccataccgcctcccttaaacagcctttaaacgataattgaccttgagttaatacgtttaaaggctgctttttatggcaaacgggaacatgaaactgtcgttggtgttaaccgcccgagatgacggagcgagacggctactggctgatactcaacgacaattagatcgtaccgcgaaatcgcgggcgcaacttgaacggcaaagccatacttatgcgttgaccggcatccgctcagaaaaacagattcaacgcgaaatcatgctgacacaggctgcgtttaaccgtttggcgcgcagcggcaaggcatcacaaaatgatttggcacgggcggcggtcgctacgcgtaaccgaattcgcgagctgaacgcggaactgaaacagggcacgggatttgcggacaagatgggaaaaatcggaagattcggtgcagctgcggtggctggtggcgcggcagcgtatacggtgcttaagcctgctatggacaacagaaagcagcttgatgagaacatcaaccgcgtgtccagacaggcatttattgaggataacagtaaatcggcagcgtggattgcaactgaaggtgcgcaacagatcaaggatttggcacttgaacttgtcgagaaaaatggcgggacccacgataaggctttggatttaatcagcggcatgatgaccaccggtctgaattttgcccaaaccaagaatgaagcgcaggcggcatatgcttttgcacttgcctcagaaggcagtggcgaggatacggcaaaactgattaaaaccctgaaagatggcggcatgagcggtaaagacctgcaactcgggcttgagcacgtcttgcaatcgggtttagacggcactttcgaggtgcgggatatggttcgggagctgccgagcctgctctctgccgcgcaacaggcagggatgaatggtgtcggcggtttggactacctgctctcactcttacaatctgcggcgaataaatcgggcagtcctgccgaagcggcgactaatgtgcaaaatcttttgagtaaaactctgtcgcctgacacgataggtcgtctgaagaagatggcaaatccgaatgacccgaagaaaggtgtcgattggataggctcggttgtgcaaggcaagcaaaacggcgaaaacgcagtgcaggtgttgtcccgtcttgccgatgccatgctagtaaaggataagcaataccaagattataagaaacgcgcggctgcaggcgataagacggcggcggagcaggcaaatatgcttaagggcgcgcttttggcgcaactgctgcctgatttgcaggcaaaacaaggtttgctggctgcaacggatatgacgcaaatccgtgaatatatggcttcgttggctggcgtaacgttggataacggaaaaattgctaagaacaacgaggcgcgaatgttgtcggcagcggcgcaacaagagcaacaggaatcgctggcaatgttgcgggaaagtctgacgggaacattggtggatatggaaacctcgtttaaaaagctggcagcggaataccctaatgccactctagccctgcaagcattgacgacggcggcaacagcggcgtctgccgcaatgttattaaccgccggtggcggtaaaggtgcaggctttctgaaagatgtaggtagtaaagcgttgggatggggtaaggcttccgcaggcggcgtggcagcaggtgccacagcggcaggcggtaagttgctgtcatggggaaaatctgccggtagcgggctcatgaataatccagcgttagttaaacgggcgggtttgttaggtatgttgctgtattccgagtctttgggtgacggcacattgccaaagggtttgcgtggtaccaagacaactcctgaaatgattaatcgtctgaaaaacaacggtatccgatttgaacctgcgccgaagcgggaacaggcgcggggtggtgtccctcagtatttggctgctccgtcagcgcagcctaccgataagatgttgtctccgttgttttcaactcagacggcggcgtatcaggcagccattcagcagcagacggcggcgtatcaggcagcattggcgcaggatacggctgcagttacaacaggtttggcacaagtgcaaagtgcgatggcgtcggcaagtcagaccatcaataccaatgtgagcctgaatatcgacggacgtgttatcgcgaatgaggtatcgcggtatcaagtggccatgttcggccgtggagcgggtcaataatgagcggatggcataccttattgcaggacgcatcttacaagggcgtcggctttgatattgaggtggtggacgagagcaacggcaaggcattggccgagcatgcgcggccgtttgtgcagggtatcgaccttgaagacatgggcatgaccgggcggcaggtgcagattaatgcggtgttttggggcaagggctatgcaggccgtctgaaaaagctgctggatgcgctggagcagccgggcggcggcgtgctggtgcaccctgtttgggggcggatgcacaacatgattgcggcatcatggagttaccgacatgaggccgattatgtggattatgcgggcatcgatattactttccgcgaggcggccgaagcgcaggaaatctttgtttttgaaaacgcctttttggtcgagcttgaggcgttgattgctaatatcgacacctaccgcgaggcggctatcggctttgttgatgcggtgttggcggtggatgcgggcgtatcagctttatggggcagcgcgctgggcatttggagtgcggcatcgggtacgtttggcgcggtgcgccgtttgtttgatttggacaaaattgcctttcccgatcggggcggatacagtgcagcggcgtttaaaaacggctcggccaagctgtttgcggatatatcggtcatggtagatactggcatacgccgtgaggcgggtttggccgataatgccatgcaccatgccggttggtcgccgcgacagcggtttgacggggctgcggctgttgccgaccgcgccgccgctatccctgataatttgctgaccggccgcttttcagacggcctgcaaaaccgcctgaaccggttaaccgccaaacaggtgcagccggtagcgcaggcggtgcgcctgttatccacgtcatcgctgttgtcggtggcaacggcattaatcgaggcgcatggcgaagagatgaccgcgcccgatttgattgaggttaaccgcgccatgcgccgccgtatgcaggccgagattgccgccttgcgggcggtgcagacggctgctgccgagtctggtgggctgacggccaacgccgtgtataccgaggcttaccaaacggcagaatccctgcgcgcggcggcaggccgtctgaatgcgttggttgcggcggtcatcaaccaaaagccgccgctgattgtgcgccaagccccaatcgacggtacgatacaccaaatcgcccacgagttttacggcgatatagcccgcgcagcagagctggtgcggctcaatccccatatccaccaccccgcgtttatcaagcgcggcactttggtcaacagctatgcaaaataattcatacggctatgccgtgtcggtgcgcgtgggcggtaaagagcaccgccactgggagcgctacgacatcgacagcgactttttaatccctgccgacagcttcgattttgtcatcggcaggttgggaccggaggcggccatacccgatttaagcggagagagctgcgaggtagtgatagacgggcaaatcgtgatgacgggcatcatcggcagccagcgccacggcaaaagcaagggcagccgcgagttgagcttgagcgggcgtgatttggccggttttttggtggattgctccgcgccgcagctcaatgtaaagggcatgacggtattggatgcagccaaaaagctggccgcgccgtggccgcagattaaagcggtggtgcttaaggccgaaaacaaccccgctttgggcaaaatcgacatcgagccgggcgaaaccgtatggcaggcattaacccatattgccaactcggtcgggctgcatccgtggctggagccggacggcacgttggtggtgggcggtgcggattacagcagcccgccggtggcgacattgtgttggagccgcaccgacagccgctgcaatatcgagcgcatggacattgagtgggataccgacaaccgcttttccgaggttacttttttggcgcaatcgcacggccgcagcggcgacagcgccaaacacgatttaaagtgggtgtacaaagacccgacgatgacgctgcaccgccctaaaacggtggtggtgtccgatgccgacaatttggccgcattgcaaaagcaggctaaaaagcagctggccgactggcggctggagggatttacactcacgataaccgtgggcggccataaaacccgcgacggcgtattgtggcaacctggcctgcgtgtgcatgtgatcgacgacgagcacggtatcgatgcggtgttttttctgatggggcggcggtttatgctatcccgcatggatggtacgcaaaccgagctgcggctcaaagaggacggtatttggacacccgacgcttaccccaaaaaggccgaggcggcgcgcaagcgcaaaggcaaacgcaaaggcgtgagccataagggcaaaaaaggcggcaaaaaacaagcagaaacggcggtgtttgaatgagtttgagtaaattggcgaaaaaaacggcacaaactgctaaaaatatcggcgaaaccctgcgcgcggcctttcggggaaaaatcacgctggtggtgtcgtccgagccgatacagcgcgtgcagttgagcggcttggccgacgaaaccctgcaagaccttgaacatttgcaggaatacggctttgccagccatccgcccgacggcagcgaagcggtagtgataccgctgggcggcaatacttcgcacggtgtgattgtgtgcagccagcacggcagctaccgcatcaaaaaccttaagcccggcgagacggcgatttttaatcatgagggtgcaaaaatcgtgattaagcaaggcaaaatcattgaggccgattgcgacgtgtaccgggttaactgcaaacaatacgaggttaatgcggccacggatgccaaatttaacgctccgttggtggagaccagtgcagtgttgacggcgcaaggccaaatcaacggcaacggcggcatggccgtcgagggcggcgacggagccacctttagcggcgatgttaaccaaacgggcggcagctttaacaccgacggcgacgtggtggccggcaatatatcgttgcgccagcacccgcataccgacagcatcggcggcaaaaccttaccggcggaaccggcatagacaagcagacctttggcagccttcgggctgctttttttgtgcgtgtgggattgaagcccgtgtactccgtgaggccgtctgaaaacggcaaaatgccaacatggacaaagagctaaaccccagcatcggcgactataccggccgcaccgtcgatacgctgcaaaatgccgtgtatatccgcttgatgacaccgttgggcagctggtgggcggataaaacgctcggctcgctgctgcatttgttgcagcgcgaaaaagacctgcaacgggtcagcctgttggccgagcaatatgccgatgaggcactgcaaccgattgttaagagcgggcgtgccgacaagattaccgtgcgcgcagagcagccgcacgacggccgcctgatcctgcatatccggatggatacggcggcgggcgggtttgattaccgccacgaagtgcccgtgatttaaagaggttttaaacgtgtttgaaacgccgacatttgagcaaatccgcgagcgtatcctgcgcgataccaaaagcctgtggccggatgccgatatcagccccgacagcgaccattatgtgcacgccagccgtttggccagctgcgccgaagggcaatatgcgcatcaaagctggattgtgcggcagattttccctgataccgccgaccgcgagtatttggagcggcatgcctccatgcgcggcttgagccgccgcaatcctaccacggccagcggcacgctgaccgtaagcggtattgcgcaatccatgctttcagacgacctgcaagtgcgtatcggccagcgtttttaccgcactaccgcccgcgccgttatcggcagcggcggcacggcggaaataccggcaatcgccgacgagccgggcgcggccgccaatgtggcgacggcgaggcgcaactgatggccgcccccgccggtgtggccaccgaatgccgccttaccgtacaaggcggcaccgaccgagaaagcgatgcctcactgctggcgcgtctgttggaaatcatccgccgaccgcccgcaggcggcaaccgttacgactataaaaactgggcgttgagtgttgacggcgtaaccagcgcatatgtttatccgctgcgccgcggcttgggtacggtggatattgccattacctccgccgacggtgtgtcgtcggaagaaactgtgcgccgcgtacaggcttatatcgacgagatgcgcccggtaacggcaaaaaatgcgctggtactcaagccaaccgtaacggcggtgcctgttaccgtgcaagtcaagctcgacggtatcgacttggacgaggccaagcgccgcatacggacggccctaaaagaatatttcgacaccctgatccccggcgacggcctgactgtgtcgcaaatcgaggctgctatcagcaatgtggatggtgtgatcgaccgccgtctgactgcgccgacggccaaccgtgccgccgatacggttaaccgcatcgagtggtttaaagcgggcgcgattaatgtaacggagatgccgtcatgagctatcaagacatcttgcggggcctgttgccccccgtgtcgtatgcccgcaatgccccgcgtgtgcgggcgcaggcagaaatagacggcgcagcgctggatgcggtggcggaatcggctcaaagcgttgccgatgccgtcgacccgcgcagcgccggccaaatgctggccgattgggagcgcgtattaggtttggacggtacgggcaaaaaccgccagcaccgtgtgttggccgtcatggccaagctaaacgaaacaggcggcttgagtattccttattttgtgcgtttggccgaggcggcgggctatcaaatccaaatcgacgaaccgcagccgttccgcgccggtgtaaaccgcgccggcgaccgtcttgcgccgcaggaaatcatgtgggtgtggcacgttaacgtgcgcggcggcaacaaccgcattacccgattccgcgccggtatctcggcggcgggcgacaggctgaccgattacagcgatgccgtgatcgagagcctgttcaaccgcctcaagcccgcccacaccgctatccgatttacctaccgctaaaggacgatttatgcaccccatcgaaacccccgataagaccttccacgacggcgacggcgtgtccgaattgggcaccatcctgcccgcgtggtggctcaaccaagtgcaatccgagctgctggccgtgctgactgcggccggtatccagccggataagtcgcagcctaatcaattactggcagcactaaataggctggctgtagttatcaccggcgaccaaaccgtcaacggccaaaaaacctttaccgcccaaacccaattccaaagcggcatccatttatccgccaaccagacgaactggaacggcggccacaaagcctacatcggcgcggatgccgacaacgcccacatcgtcttcggcgacgacaccctccgcctgcacggcgcaaacaaccgcatttcctacaacaaccacgacatcttccacaaagccaacaaaccgcgttttgccgaagacatccaaggcaaaccgaacacactgtccggatacggcatcggcaatttcaaagtcgaaacattccggggcgatttgaacaccctcaaaacagacggcatctattccctgccgacggcggtcggcagctccaacctgcccgttgaaaacaccgcctgccatatccaagtcatcgccggcacgaaacacggctggtgcaggcagttgggttatcccgcctacacgtccgacgtgtacgaacgccaccaaacgagcagcgcaaacgacaactggtccgcatggaaaaaactcaattcggacggcatccccgtcggcgcgatcgtatcctttcccaaagccgtacaaaaccccgcaggctatctcaaagccaacggcacgacctttgcacaaaacaccttccccgacctttaccgcgccttgggcaacagcaaccgcctgcccgatttaagccgtaccgacatcggcatcaccgcgtggtttccgtccgaccaaatcccgaccggctggctggcgtttgacgacatccgcacgcgcgtaaccgaaaccgcttatcccgagctgtaccgtctgctgaccggaaaatacggcagcatccaaaacgtcccgcaggcggaagaccgctttatccgcaacgcgggcaacagcttggcagtcggaacgaagcaggaagacgaaatcaaacggcacgtccacaaagtattttcacactggacaaaccacacagacgcggcagccctcggttacgaagaccgcaacgaaaggcagagaagcgcgctcgtatcgacttggacggacgaaaatttaaacgacaacggctttttaaccccgcgctcggacagcaaaatggcgacaggcggcgacgaaaaccgccccaaagccctggttttaaaactgtgcatcaaagccgccgacaccttgggcgaagccgtgttttggataaagtcccacggcgaaaccatcaacgcaggcgcgctggacgcgggcacgctggcgcaaggtttgcaagacaaagccgaccgagaccacacccacaccgccgcccaaatccaagggctggacgaaaaaatcagcaccgccgttgccgcgcaattcacacgccaaaccatcggcggcgtggatattgtcagattccccgacggcacaatgatacagaccggcagctacaggttcacacgaagcggcggccccatcgaaaacgaagtcgtcttccccgtcgcctttgccgacggcaacgtcaaatgcttcgtatccgaacgccattcggaacgcgttaccggcgatcgaaggcaacacaactggctgtttatccgcgcaaaaaaccacgccgccgccattatcaccaactggtacgaaggcagttgcgactggatggccatcggcaaagccgcctcgggaaacgccgccagctccccgataggccccgaaatacctgaaaccaacgaagaaccgcaaagagagagtggaagaacatcaaccggaccccgaaaccgccgccgccgagacggcttgctcgaggcactgcaagactagcgggctgtagagatggctgtagagacgggctgtagagatggctgtagagacgggttgtagagacgggttgtagagacgggttgtagagatgggttgtagagatggctgtagagatggctgtagagatggctgtagagatggctgtagagatgggctgtagagatgggttgtagagatgggctgtagagatgggctgtagagatgggctgtagagatgggctgtagagatgggctgtagagatgggctgtagagatgggctgtagagatgggctgtagagatgggctgtagagatggctgtagagatggctgtagagatggctgtagagatgggttgtagagatgggttgtagagacgagttgtagagatgggcttcagcccgccgatccaagcaatccgaccgaaaccggccgcgccgccaatcccccgaaacctatgccccgccaatcctgccactcttcgtcattcccgccgctttcgtcattcccgcgaaagcgggaatccagaccccccgacgcaacaggaatctatcggaaaaaccgaaacccccgccaccgtcactcccgcgaaagcgggaatccagcccccaaacgcggcaggaatctatcagaaaaaacagaaacccccgccgccgtcattcccgcgcaggcgggaatccagaccccaaacgcggcaggaatctatcggaaaaaacagaaatccccgccgccgtcattcccgcgcaggcgggaatccagaccccaaacgcggcaggaatctatcggaaaaaaccgaccccccgccaccgtcattcccgcgcaggcgggaatccagaccccaaacgcggcaggaatctatcggaaacggctgaaaccgaacggactggattcccgcctgcgcgggaatgacggcggcaggggtttcgggattcccgccttcgcgggaatgacggaaagtggcgggaataacgaaaggcgggaatgaccgcgcaaaaagccgctgcccccttcggacggcaccggcaacaaaaaaccgcacggccgaaaccgcgcgggaaaggatagtcgggcgcgcccgataagcagcggccgcccccgttatttcaattgggcgatatattggcgcaaaacctcgttgatgcgcgtctgccagcccttgccgccggcgcggaatttttcgaccacatcggcggacaggcgtatggtaacgagttgtttcggggttttgcctgtgtttcgtttttgcattacgcccttttcttccaattgtttttgatgggaaaaaagcacctgtgccaagtcttcgggcagggcttcggcaatggggcgggcaagcgcaaaatcttcggcggcaagttcccgcacttcgccgtcagcgtttgttaaggattgacgttgcatattttttaacctctcttttattcgctttgcgaaaactgatgacacggatgccgtcttttatcggcgtaaaacagacaatgtgcaggcgttgcgtatcgcctagataagcagcggcaacataacgcggttcggggtaatcaaagcggacatcgggcacaataacggccgttgtccagcgtatttgcccgactgattcaaagggcaaattccgctcttcgatattgcgttgatttttttcggagtcaaattcaatcttcattgcagcttgcagcgtattttgtcgttacattataagcggcaaaaaaccaaaatgtaaatacaaaaaaggaaaccccaaaatgaccatctatttcaaaaacggcttttacgacgacacattgggcggcatccccgaaggcgcggttgccgtccgcgccgaagaatacgccgcccttttggcaggacaggcgcagggcgggcagattgccgcagattccgacggccgccccgttttaaccccgccgcgcccgtccgattaccacgaatgggacggcaaaaaatggaaaatcagcaaagccgccgccgccgcccgtttcgccaaacaaaaaaccgccttggcattccgcctcgcggaaaaggcggacgaactcaaaaacagcctcttggcgggctatccccaagtggaaatcgacagcttttacaggcaggaaaaagaagccctcgcgcggcaggcggacaacaacgccccgaccccgatgctggcgcaaatcgccgccgcaaggggcgtggaattggacgttttgattgaaaaagttatcgaaaaatccgcccgcctggctgttgccgccggcgcgattatcggaaagcgtcagcagctcgaagacaaattgaacaccatcgaaaccgcgcccggattggacgcgctggaaaaggaaatcgaagaatggacgctaaacatcggctgaaaaaatacgtttaccacctgttggtagccatcgaccaactgttcaacgccctaaccggcggcgcggcggacgaaaccctctcaagccgcacctatcgccgcgcgcggctcgcccaaaagcccaaaacccgctggaagattttatataccctgatcaacggcgtgtttttcgaccgccaccactgccggcaggcgtatatcagcgaactgaaaggcaggcagcacgacgcgcggttcaaccaaagccgcgccgccggggaaaaggggacgcgatgaactacttcggcatggtagagtttctgcgcctgatggcaatggtgcggccgccatttgtcttcttctccggcacccgcagcgaactgcctgcttatcttgacctcgtggcagaactgcgcctgaccggatgggagcgttttgcaggcagccaaaccttgactgtgagcagcacatcaacagcaattcaagctacgacgaccacctgatttataagttctgaccgcaagtagcgtactacttttaaaggcataagataatccccgtttaacagaccattaaacggggataaatttgtgcaaaagctaatacaatttcctacgcttcggcggtgcaaaagctgccgccaattcgtgcaaaagctgccgccgccttacattccagtgcaatgccgtctgaaacttcgctaatctcgggttgccgcgcgctgtgttgttcttcggtactcagcaaaaagccgtacagacgctccaatcgggcgcggtaggcggtgaatttgttgtagaacatccggaagaaagaaagcgcgttttgcagtcgcgcgaaggcttggacggtctgctggatgtcgccgattttgatttgtccggcaaacaggcgcggcgcttgcaaaataatggggaagagcttgatgccgttggtgaacatatcattaaagccgctcaggcagacgctttgtcgcgcaatacgccagcggttgcggataatggctttaaaacggtcagaaagctggtcgtgttcgtgtttttcgccgctgtaaaacgccacgctttcggcgtggtcgcgcacgcggatgagggaataacggtagtcgccgttgagtttttcgttttcataattgtaacgaatcaaagggttgcctatccacatggcgataaaggtcgccaaaatcacaaatatatagacaaaccaaacgatgccgtgcggaatgtcgaagccgaacacggtcaggatgccagccaagccccgcaaaacaacggcaaattccagagaagtaacgaccgaattgaccatgccgcgcacaaattcgatggtcgaagcgataaattcctgcgcgtcctgttggatacgctggtcgatgttgtccggcgcgtggcggcgcatttgcaggcggtagtagtttttgtcggcaagccagcgtgctgtcagcacttcgttgagccgctccgaccatttaatcgccaagccttgatcgaggaagtcgttgacgacgttgttaaacgcccgtatcagcaccacgcccgcgttcattgcagcaaacatccaaaatgccgaagcatttcaaatcctgcatcgagtcgtaaagccctttggacataaaggtactcaacacattcagccgcatttcggttaacaccagcgtaatcatcgccgtaatcagcagcaagactttgaccgcgcttttcggtgtcagacaaagccaaagcggtgtggaataaagctcggtttgccatttctgcatgggaaatttcttacggtatcaatgccgtctgaaaaagacgggtacagttgattttttgatgaagtttggggaagttttgccggtcagggtacattgcgtgttaatttatagtggattaaatttaaaccagtacagcgttgcttcgccttagctcaaagagaacgattctctaaggtgctgaagcaccaagtgaatcggttccgtactatttgtactgtctgcggcttcgtcgccttgtcctgatttttgttaatccactataccatacaaccacgccggaattaagtttaaatttgaataaaaggttcgggttctgcaaaatacagaacccgaaccttgttcggatattgaaaccggctgcccgattttgggcggtgcggcttgcaagtatcaagattcgcatatgccgtctgaagctcggagaggttcagacggcatatgcttatttgggctgctcttcaacgaatctcggacctttcaagatgccgttgtgagaatagggcgacagcaggttgtatgcggcggttttggaaacctgataaccgcggtcggtcaggctgttggcaatctgattgaccactgcgctgaccaaagcccccaacaggccgctgttgctgttgttgctgccttcgcggatgctggccgaacccgaccacaactcttttccgttgcgggaatcgaccagccgtgctttggcggatacggtcgtcacgctgtctaaaatttgatatgaagtgccgtattcggtaaccgtaatgtacaaaaccgcatcattgccgaaaatctgatgcagtttttccggccggacggcgtgaatatcggcggcattggtcaagccgttttgtttgaaggtttcctccacgactgcggcggggaagacgtaatagccggcttcggaaagcggcgcggcggtcgaagccagtacaccccatgttccgttgacatcgggcgattcgttcagcggcggaaccaccaaaattgaagccggtttgctttccttgaatgacgtgtagtcgaaatcgggcgctttttgaacttggcaggcagacagcgccaacacggcggcaagccctaaaatcaaaggtttcatcgcttgcctcctttaccggttttcatcaggaagtccataaatacgcccgattcgggaaacagccttttctcttcttcaaactggcggaacgcgccctctttgtctcccgaacgggaaagcagcagtcccagatgggcgtgcgcacccggggcgagcattcatttttattgttgccgngcttccacaaaggtatttttccattcttttcggatctgctgtgcccaacgaaagtgtcgttcgtttttcaaacct

SEQ ID NO: 37810 - DNA, 9560 bp, Neisseria meningitidis
cgcgtccaaatcaaccgcgacaccggcgaataccaaaccttccgccgctggctgattgtcgccgatgaagctatacctatcccgatgtcgaaaaaaccatcgaggaaatccaagaggaaattcccggcactaccatccaaatcggcgaatactacgaagagcagctgcccaacgaaggcttcggccgccaagccgcgcaaaccgccaaacaaatcatcctgcaacgcatccgcgatgccgagcgcgagcagaatctgaacgagtttctcgccgtcaaagaagacatcgtgtccggcacggtcaaacgcgtcgaacgccacggcatcatcgtcgaagtcgttgccggcaaactggacgcgctgattccgcgcgaccaaatgattccgcgcgaaaacttccgcagcggcgaccgcatccgcgccctcttcctgcgcgtcgaagaaatcggcaacaccggccgcaaacaagtcattctgagccgtacttccggcgatttcctcgtcaaactgtacgccaatgaagtacctgaaattgcagacggcatgcttgaaatccgcgctgtcgcccgcgacccgggacaacgtgccaaagtcgccgtcaaagccaacgaccagcgcatcgatccgcaaggcacctgtatcggcgttcgcggttcgcgtgtcaatgccgtcagcaacgaattgtccggcgagcgcatcgatgtcgtcctctggtcgcccgaacccgcgcaattcgtgatgagcgcgctctcacccgccgaagtcagccgcatcgtcatcgacgaagacaaacacgccgtcgatgtcatcgttgccgaagaccagctcgcgctcgccatcgggcgcggcggtcaaaacgtgcgccttgcttccgacctgaccggctggcagctcaacatcatgacttccgccgaggcagacgaacgcaatgcggcagaagatgccgccatccgccgcctgtttatggatcacttgaacgtggacgaagaaaccgccgacgtactggttcaggaaggttttgcaaccttggaagaagtcgcctatgttcctgccgccgaactgcttgccattgaaggatttgacgaagaaatcgtcgatatgctccgcaaccgcgcccgcgatgccatcctgaccatggcgattgccgccgaagaaaaactgggcgaagtgtccgacgatatgcgcaacctcgaaggcatagatgccgatatgctccgcagccttgccgaagcaggcattaccacccgcgacgacttggcagagcttgctgtggacgaactgattgaaatcaccggtgtaaacgaagaaaccgcaaaagccgtcatcctgaccgcacgcgaacactggtttaccgaagacaaataaagggggtacagatgagtaacacaaccgtagaacaatttgccgccgagctgaaacgccccgtcgaagacctgttgaaacagttgaaagaagccggcgtcagcaaaaacagcggcagcgattccctgacgctggacgacaaacagcttctgaacgcctacctgaccaagaaaaacggcagcaacagcagcaccatcagcatccgccgcaccaaaaccgaagtcagcaccgttgacggcgtaaaagtcgaaacacgcaaacgcggacgcactgtcaagattccttctgccgaagaattggcagcacaggtaaaagccgcccaaacccaagccgcacctgtccggccggagcagacggcagaagacgcggcaaaagcccgagccgaagctgccgcacgcgcagaagcccgtgccaaggcagaagcggaagcggcaaaactgaaagcggcaaaagcaggcaacaaagccaaacctgccgcgcagaaacccaccgaagcaaaagccgaaaccgcacccgttgcggcggaaaccaaacccgccgaagaaagcaaagcggaaaaagcccaagccgacaaaatgccgtctgaaaaacccgccgagcccaaagaaaaagccgccaagccgaaacacgagcgaaacggcaaaggcaaagatgccaaaaaaccggcgaaacctgccgcacctgccgtgccgcaacccgtggtcagcgcggaagaacaggcgcaacgcgacgaagaagcacgccgtgccgccgcacttcgcgcccaccaggaagccctgttgaaagagaaacaggaacgccaggcacgccgcgaagccatgaaacaacaggcagaacaacaggcaaaagccgcacaggaagccaaaaccggcagacagcgtcccgccaaacctgccgaaaaaccgcaggcagccgcgccagccgtcgaaaataaacctgtcaatccggcaaaagcgaaaaaagaagaccgccgcaaccgcgatgacgaaggtcaaggccgaaacgccaaaggcaaaggcggaaaaggcggacgcgaccgcaacaatgcacgcaatggcgacgacgagcgcgtacgcggcggcaaaaaaggcaaaaaactcaaactcgagccgaaccaacacgccttccaagcaccgaccgaacccgtcgttcatgaagttttggttcccgaaaccattaccgttgccgatttggcgcacaaaatggcggtcaaaggcgtggaagtggtcaaagccctgatgaagatgggcatgatggttaccatcaaccaatccatcgaccaagacaccgccctgattgtggtggaagaactcggccacatcggcaaacctgccgcagccgacgaccctgaagcattcttggacgagggcgcggaagcagtggaagccgaagcattgccgcgtccgcccgtcgttaccgtgatgggccacgtcgaccacggcaaaacctcgctgctggactacatccgccgtaccaaagtggtacagggcgaagcgggcggcattacgcagcacatcggcgcgtaccacgttgaaacccctcgcggcgtgattaccttcttggacaccccgggccacgaagcctttaccgctatgcgcgcacgcggtgcgaaagcaaccgacatcgtgattctcgtggtcgccgccgacgacggcgtgatgccgcaaaccatcgaagcgattgcccacgccaaagctgcgggtgtaccgatggtggttgccgtcaacaaaatcgataaagaagccgccaacccagagcgtatccgccaagagctgaccgcacacgaagttgtgcctgacgaatggggcggcgatgtacagtttatcgacgtttccgctaaaaaaggcctgaacatcgatgcattgctcgaagccgtcttgctcgaagctgaagttttggaactgaccgcacctgtcgatgcgcccgccaaaggcatcatcgtcgaggcgcgcttggacaaaggccgcggcgcggttgccacattgctggttcaaagcggcacgctgaaaaaaggcgatatgctgctggccggtacggcattcggcaaaatccgcgcgatggtcgatgaaaacggcaaatccattaccgaagccggtccgtccatccccgtcgaaatcctcggcttgtccgacgtaccgaatgcgggtgaagacgcgatggtattggcggacgagaaaaaagcgcgcgaaatcgccctcttccgccaaggcaaataccgcgacgtgcgccttgccaaacagcaggcggcgaagctggaaaatatgttcaacaatatgggcgaaacccaggcccaatctttgtcggtcatcatcaaggcagacgtgcagggctcttacgaggctttggcgggcagcctgaaaaaactgtccacagacgaagtgaaagtgaacgtgttgcacagcggcgtgggcggcattaccgaatcggatgtcaaccttgccatcgcttcgggcgcattcattatcggctttaacgtgcgtgcagatgcctcttcgcgcaaacttgccgaaaatgaaaacgtggaaatccgctactacaacatcatctacgatgccatcaacgacgtgaaggcggcgatgagcggtatgctttccccggaagagaaagaacaggttaccggtacggtcgaaatccgtcaggtcatctccgtttccaaagtcggcaacattgcaggctgtatggttaccgacggcgtggtcaaacgcgattcccatgtccgcctcatccgcaacaacgtggttatccacacgggcgaactggcttcgttgaaacgctataaagacgatgtaaaagaagtccgcatgggcttcgagtgcggtctgatgctcaaaggctacaacgaaatcatggaaggcgaccaactggaatgcttcgacatcgtcgaagttgcccgcagcctgtaattcctttgcaaataaaatgccgtctgaagcgttcagacggcatacgaaacgggttctgtatcatacagaacccgttttttgtcgcaaatcggcttcagacagccctcttgccttatcccgatttgaatctgacttgccatacaaacaggcttcagacggcattatttgcccgctaaacgtatcccaagcttctccgcatattccctgcgttcggcgcggctggtttccgggcggtgcgtattgagcgacgaccatttccaatgactgcgggctttgttgagttcgggcgggagtctggcggcatcccacgggactttgcggctgtgcagctcgatatccgactgtgccgcgtgtccgcgcgtttgcaggacgtggagcaaatcgagggcgcgggcggcgagcagggtcagggtttcagggtcggtgtgcagggtttggcggccagcgagtttgtcggaaatggtgcgggtattgggcaggatgccgcccaaaaagccgccgattgccgtacccaatccgagcgagccgccgagtgtggcgatgtccagccccaagccgatgagcgcgccggttgccgcgcccgtgccggtgcggatgccgtattgtttgagcaattcgctgtcgaacgggtcttggcggaaggcttgcggcatccagtcgccgccgtcgatttcgctgtggtagaaacggtagagggcaaacagccgctgctgcatctgccgttcgagttggcgtatttccgcctgcatggtttgcagcacggtggcggtatcctcgttttcgtccacttcctgcctgaaggcggcggcatcaattaaaaagtcggcgatttcgcggcgcgcttcgccgtccagccgctgccattcgcgccggcgcatggctgtcaggcggtcaagtgtgctgcgttcgggcaacatggtggcgaggttttcccacaggcgcagttcgccttcaaaatcaaaggcgacggtgtcgaaccctgcgaaaacgtgcaggtttctcctcgccagcatggttgtccacgattcgggaagctgtccgccggtaaagttgaacacgggcataaccggtttggcacaccatgaaaggatggtcaactcgtccctgtatttgtcgaggacgggttcgcgcgcgtcgatgacgtacattgccatatcgctttgcaagacttgccgtaagactttggcttcctgattgaaatcatggtgcgcaccgtggctgccgagaaactgttgcagccgttcgatgccgtctgaacgattgtccgtatggttttccagccattccagcacgccgcccgcgtcttcgagtccgggcgtgtcgtacaggaaaaccagcgtgtctgcgccgtcgctgatggcggcttcttcgacatgacgcgtggtcgatggggcgtttttgacttcgccgaaaccgctgtcgcgcaaaagggtacgcaggagcgaggttttgccggtgttggtgtgtccgacgacggcgagggaaaggggttgtttgttcatgatgtttttgaagaatggattttcagacggtcttttttcagaatggcggcttaacagaacatttcaagtgagtttattggtctttcaaacgcccttcctgcgccgccctgtcaggctcaagccacgccgcgccgcattcggccagcgcgttacgccaatgttccagcttttccgaaaggtcgtctgaaagcccctgttccgccaaaagctgcaccaccgcgccgccctgcgccgcttccgagagtcggacaatctgccgcaacacgccgcggtccggcacagtttgggcgcgcacgccgataagcagttgcgccggtttctgcttcagctctgtctccagcgcggcaacctgttcccgattggtggcaacgcccttatccagccattcctgcgccagcctgccctcgaaccattcgccgtcctgccactcggtctccagcatgaccgcccatttcggcgcatcgttcaagatgattttcggtgaaacggcggacacggtttcccgacgcgtatccgcatcggtgattttgttctgccagcggcggatgaccgcctgataatagggcttttccaaatccaatccgttttcgcttgttttcaaaaggattttacacactacccaagccagcaggcgcggcaggatgccgtagcaggcgatactgccgaccagcagccccgaccaagcccgcgcatcggcaatattgccgttcagacggccttcgatgaccgcccgcgcatcggggacagggaaaccgagtttcgacggcagccatgccaacatttccaccgcgcgtaccgaagcggcattgctcaacagcgtgctttcccagttgaacgtatattgccgcaccaaaagcagcaacaataccgacaccagcattccgagcagcgtgcagagccacaggctgtgcgacgttgcgcctattttccaacgtaccgaaggttgccgccactcgtccgcatacagccgcaacaccgcctgatttacagggtctttgccccgaaaccacgtcgccggactgctgaaaaaacgccccactttcacacgcaggaacaacattgccaaccatactgccagcatcagcgtattcatgcccaacacgcccgccaaaaccaaaaagaaattcagaccctgattgtccattagaagataagtgactgaaaaaccggtaaaaaatgcaaacgtcgccgccaccacccacaaccagaacgaccccgcacgcacacgttccaacgtctcccgcagcatacggttcctgtcaatcatctccgcccgacggatgattttttcctccgtactgccgtccacgcggcgcaaagcctccgtcgcctgtacgggatcgccgctgaaaataaaaccgccttcgtccaaaatacggaccagctcaaccagttttcgggatggattcaacataaaatgccgtctgaaaataaaaaacagattttaacacacgcattttcaagaatattcacagtgtaggcaaagagtaaatctcacacagaagcaaaagtatcggcgtaaactgactgcctctactttcccgaaagattgtgcgatgtatacaggcgaacgcttcaatacttacagccatttgagcggtttgattctggcggcggcaggtttggcgctgatgctgctgaaaaccataggacacggggacggctaccgtatcttcagcgtatcggtttacggcatcagccttcttctgctctatttgagttcctcgctgtaccacggaattgcagccggaaaactgaaaagcattttgaaaaaaaccgaccactgcatgatttatgtgctgattgccggaagctacacaccgtttgcactggtttctttgagaaacgggccgggctggacggtattttcactgtcctggctgctggcggctgcaggaatcgcacaagaactcaccatcggacggaaaagcgaaaaacgtctgctgtctattgtgatttatgtcgtcatgggttggatggtcttggcggtaatgaaatccctgacagcctcactcccgtcggcaggactggcttggctggcggcaggcggtatgctgtacagtgtcggcatttactggtttgtaaacgatgaaaaaatccgacacgggcacggaatctggcatctgttcgtattgggcggcagcatcacccaatttgtcagcgtgtacggttacgtaatctgaatgccgtctgaaaagcaaaacctcccgttcctgaagattgggaggttttctgtttgccggacatcagcccttgtcgtggaactcgtggaattcatactgataggacaaatcccgacccgcttttttctgtgccaaataatcatcataaatggcgcggatttccttacgcaacaaaaacagggctatcaggttggggataaccataaaaccgttgaacatatccgacagactccaaaccaaatcgactttgccgagcgtacccaaaacaatggcaagcagaaccaatgcgcgatagatgcccaagtgtcttcccctgaaaagaaaacggatattggactcgccgaaataataccaaccgatgatggtggtgaaggcaaagaaggtcagacacacggcaagcaattgcgaaccgaagcccggaaatgccttgttaaaggcaaattgagtaaccgccgcgccctgttcgcccgaaaggttggcatcggtcagcaggataatcaatgccgtagccgtacataccaaaatcgtatcgataaacacaccgacaaatgccgccataccttgctgcacagggtgcttcacatccgcagtcgcgtgggcgtgcggagtcgaacccatacctgcttcgttggaaaacagaccgcgcgccacgccgaaacgtatcgcttcgcgcataccgatacccgcagcaccgcccaaaacggcttcgggattgaaggcggcggtaaagatgtggttgaacatcggcacaatatggtcggaaaattcaaacaggataacgacggcgcacaaaatataaacaaccgccataaacggcacgacaaattgggcgatattggcaatacggttcacgccgccaatcacaaccatgcccgcaaggacggcaagcacaataccgactgccaaagaaggcacatcaaatgcaatggtaacggcagaagcaatggagtttgcctgtgtcgcattaccgataaagcccaatgcgataatcaacgcaatggaaaagaaaccggacaaaaaacgcgccgcgcccctgccgattttcggagtcagaccgtgggtgatgtagaacgccggcccgccgatgtatttgccgtggctgacgacgcggtatttctgcgccagcagtgcctccgcaaaaatcgtggacatccccaaaacggcagaaacccacatccaaaaaatcgcgcccggcccgcctgcggtgatggcggtcgccacgccggcaacgttgcccgtaccgatttgcgcagatatggcaaccgccaacgcctgaaactgcgataaagacttgtcgtctttatcgcctttggcaaacaagccgccgaatacggatttgaatcccgcgcccagcttggtaatctgcggcgcaccaagatacagcgtaaaaaacaggccgatacccaaaagcgcgtaaatcagcaggtagtcccaaaggaaccgattgactgtacccaccagaacagacaatatattttccataaaataaaccttatcttacaattaaaatgactgccttccaaaagacattccaataaggaaacacggcgagcagaccgtatttgccgcaacagatgccttaaattgtcaacaatcggggagaagctgcgc

SEQ ID NO: 37811 - DNA, 352 bp, Neisseria meningitidis
  misc_feature (1)..(352): N is any nucleotide
ccttcgaccaaaacgacttcgtactgcgccgccaattcttgtgtggcggtgcggattttgtccaagtccaaagccctgccatccagtcgggcggcgaggtgaggcgaanggngatagctgaagatttcgggcatagtcagccgccgtttgtcggcttcctgcatcggtatgcccataattttgcggtggacggcgatgtcgtcggccaataacctcatgatggaatagtaccgtttttcaaaggtactttaatcatagagcgtcgagcttgatccattgctttttgaacagcaactggtacttcttttgatttacctttgcccataccaatgngaccatnaccatcaaccaa

SEQ ID NO: 37812 - DNA, 22863 bp, Neisseria meningitidis
tttattatgctgcctttcctgctgtatttcctgtccggtaccctgagtcaagagtctgcatttgaaacttaccgtgccattgtttcccatcctttggtcaagctggttttaatcggtgtattgtgggcttatctgcaccattctctcgccggtatccgctttttatttttggatgcgcacaaaggccttgagctgaatactgcgcgcaataccgctaaagccgtatttgcttctgcattggttttgactgtcgttttgggagcgttgttatggtagaacgtaaattgaccggtgcccattacggtttgcgcgattgggtgatgcaacgtgcgactgcggttattatgttgatttataccgttgcacttttagtggttctattttccctgcctaaagaatattcggcatggcaggcattttttagtcaaacttgggtaaaagtatttacccaagtgagcttcatcgccgtattcttgcacgcttgggtgggtatccgcgatttgtggatggactatatcaaacccttcggcgtgcgtttgtttttgcaggttgccaccatcgtttggctggtcggctgtctcgtgtattcagttaaagtgatttgggggtaagtatgggttttcctgttcgcaagtttgatgccgtgattgtcggcggtggtggtgcaggtttacgcgcagccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccacccgaccggcgtggcgggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggcattccgaccaattaccacggcgaagttgtcgttccgcaaggtgaagattacgaagtgcctgtaaaaggtctgtatgcggcaggtgagtgcgcttgtgcttccgtacacggtgcgaaccgcttgggtaccaactccctgttggacttggtggtattcggtaaagctgccggcgacagcatgattaaattcatcaaagagcaaagcgactggaaacctttgcctgctaatgcaggtgagttgacccgccaacgtatcgagcgtttggacaaccaaaccgatggtgaaaacgttgatgcattgcgtcgcgaactgcaacgctctgtacaactgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctgattgaagtggcgaaagcgactttggtgtctgccgaagcacgtaaagaatcacgcggtgcgcacgcttcagacgaccatcctgagcgcgatgatgaaaactggatgaaacatacgctgtaccattcagatatcaataccttgtcctacaaaccggtgcacaccaagcctttgagcgtggaatacatcaaaccggccaagcgcgtttattgatgcgttttcagacagtcttcgcctcaaaggtcgtctgaaatctaaccatacccacattgaactgcttgaatttataatacaaaatcattgggcagttgatgagaaaaggaacacttctcatggaaaaaatgagttttgaaatttaccgttacaacccggatgttgatgccaagccttatatgcagcgttacgagttggaattggaaccgaccgacgtgaaacttttggatgctttggtacgcctgaaagcacaagacgataccttgtctttccgccgctcctgccgcgaaggcatttgcggatcggacggtatgaacatcaacggcaaaaacggcttggcgtgtttgaccgatctgcgtggcttgaaacagccagttaaaatccgtcctctgccaggtctgcctgttatccgcgacctgattgtggatatgacccagttcttcaaacaataccattccgtcaaaccttatgttgtcaacgataatccgattgatgcggacaaagagcgtctgcaaactcaggaagagcgtaaagagttggacggtttgtacgagtgtattttgtgcgcctgctgttcgactgcctgcccgtcattttggtggaaccctgataaattcgtcggtccgtccggtttgctgaatgcttaccgtttcattgcggacagccgtgataccatcactaatgagcgtttggataatctgaacgacccataccgtttgttccgttgccacaccattatgaactgcgtagacgtatgtcctaaacacttgaatccgacccgagccatcggtaagattaaagagattatgttgaaacgggccgtttaagaaatgatggtttttgacgatattgccaaacggaaaatccgttttcaaacccgccggggattgttggaattagatttaatcttcggcaggtttatggaaaaagaattcgagcatttgagcgataaagagctgtccgagttttccgaaatccttgaatttcaagatcaagaattgcttgccttgattaacgggcattcggaaacggacaaagggcaccttatcccgatgcttgaaaaaatcagacgggcatgaggcatctgaaatctgcctgcaggcagatttcaaaatgcaaaagccgtctgaaggcaaagaacgtgctgcggatgcagtaacgtgggttataacttgcaaaggagcaataatatgtccaaatcaatcaaactcaacgtaccgggtcaggcaggtttggagctgccggtattggaagccagcatcgggcacgatgtggttgacattcgggggctgacaaaaaatacaggtttgttttccttcgaccccggatttgtttcaaccgcaagctgtgagtctaaaattacttacatcgacggcgatcaaggcttgctttattatcgcggataccccatcgagcagctggccgaaaagtccgattatttggaagtctgctacctgttgatttacggcgaactgccgactcccgagcaaaaggcagaatttgacaataccgtccgccgccacacgatggtgcatgaacagctgacttggttcttccgggggttccgccgcgacgcgcatccgatggcgatgatggtcggcgtggtcggcgcactgtctgcgttctaccaagacagcttggacattagcaatcccgaacaccgcaaaatcgcgatttaccgcctgatttctaaaatcccgaccattgcggcaatgtgctaccgctattcaaacggtctgccgttcaattatccgaagaataatctttcttattccgaaaacttccttcatatgatgttcgccacgccgtgtgaagactacaaacccaatcccgttttggcacgcgcgctcgaccgcatctttattttgcatgccgaccacgagcaaaacgcctcaacttcaaccgtccgtctggcagggtcttcgggtgcgaacccgtttgcctgtattgctgccggtatcgcctgcctgtggggtgcttcgcacggcggtgcgaacgaagccgtgttgaaaatgttggacgaaatcggcgatgtgtctaatgttgccgcatacatggaaggtgtgaaacaacgcaaataccgtctgatgggcttcggtcaccgcgtgtaccgcaatatggatccgcgtgccagcattatgcgcgaaacctgctatgaagttttgaaggaattgggcttggaagacagtccgaaattcaaactggcgatggaattggaacagattgcgctgaaagacccgttctttatcgaacgcaaactgtatccaaacgtcgatttctattccggcatcgtcctgtccgcgctgggcatcccgaccgaaatgtttaccgtcatcttcgccctgtcgcgcagcgtgggctggatttcgcactggcacgagatgattagcgatccttcgctgaaaatcggccgcccgcgccagctttataccggttcggaacgccgcgattatgtgccgccaggcgagaggtaacatacattaatatattgtcaaacaggcaatatcagagaaccggattgtttcccgaatccgtctgattgtagtcggatgaaatcaagacaagcaatccggtttaaaatagggtagaataaaatgtcttttcaggcggcatcagtttagccgtcaggacgcggacttctaccctttgtttatattttaaagaaaagagcgcacgccatgatggacgaaaaactcaatttctcttacctgttcggttcaaacgcaccttacattgaggaattgtacgaggcttttttggaaaaccccgatgcggttgatgaaaaatggaagcagtatttcaccgatttgagcaaacagccggggacggttgctgtcgatgtcgcacacacaccgattcgcgaatcatttgttactttggcgaaaaagaaaattgcatctgccgttgcgggcggtgcggatgaggcaatgctgaaaaagcaagtcagcgttttacggctgatttccgcctatcgtatccaaggcgtgggtgcagcccaacttgatccgctcaaacgtatccccccgcgcgatattgaagccctcgatccgaaattccacggtctgtcagatgccgatatggcgcttcaattcaatatgggcgagggcgattttgccaatcgcggcaaactgcctttgtcccaaatcatcagcaacctcaaacaaacctactgcggccacatcgcattggaatatatctatattcccaataccgaagagcgccgctgggtacgcaattattttgaaagcgtattgtccacaccgcattacaatgccgatcaaaaacgccgtatcttgaaagagatgactgctgccgagactttggaacgttatctgcataccaaatatgtcggtcagaaacgtttcggtgtcgaaggcggcgaaagcgcgattgccggtttgaactacctgattcaaaacgccggtaaagacggtgtggaagaggtcatcatcggtatggcgcaccgtggccgtctgaatgttttggtgaacattttgggcaaaaaacccggcgatttgtttgccgaatttgaaggtcgtgccgaaatcaaactgcccagcggcgacgtgaaataccatatgggcttcagctccgatattgccacgccgcacggcccgatgcacgtttctttggcgttcaacccgtcacacttggaaatcgtcaacccggtggtggaaggttctgcgcgcgccaaacaaaaacgtttgggcgaaaacggccgcgacaaagtcttgccggtattgattcacggcgactccgcatttatcggtctgggagtcaaccaagcgacattcaacctgtctaaaacgcgcggttataccaccggcggtacggttcatatcgtcatcaacaaccaaatcggctttaccacttccgatatccgcgatacccgttcaaccgtacactgtaccgatatcgcaaaaatggtttccgccccggttatccatgtgaacggcgatgatcccgaacgcgtttgctttgctatccaagccgctttggattaccgcaaaaaattccataaagacatcgtgattgacgttgtctgctaccgtaaatggggtcacaacgagggcgatgatccgaccttgacccaaccgatgatgtacaaaaaagtatcgcaacaccccggtgcgcgtgctttgtacaccgagcaactgattgccgaaggcgtggtaacccaagccgaggctgacggttacatccaagcttaccgtgatgctttggacaaaggcgagcacgtcgagcaaacaacgttgagcaacttccaacgcacgcaaatcgactggagcaaataccaaggcaaagattggcgcgaacacatcgaaaccggtttgcctgccgcagatattgaacgtctcactgagaagtttaccgccgtaccggaaggctttgccctgcatccgactgcaaaacgtgtgattgaagcgcgtaaagccatggcatccggcaaacaggccatagattggggtatggccgaaaccttggcatacgccagcctcgtaaccaaaggtcacggcgtgcgtatttccggcgaggactcgggacgcggcacgttctcgcaccgccacgccgtattgcacgatcaaaaacgcgaaaaatgggacgacggtacttatgttcctctgcgccatatgggcgaaggcatgggcgagttcctggttatcgactccattttgaacgaagaagccgtgatggcgttcgagtacggctttgcctgctccgcacctgacaaactgaccatttgggaagctcaattcggtgacttcgccaacggcgcgcaagtgactattgaccaattcctgtcttcaggcgaaaccaagtggggtcgtttgtgcggtctgactaccatcctgccgcacggctacgacggtcaaggccccgagcactcttctgcacgcgtagaacgttggttgcaactgtgttctgagaacaatatgcaagtcattatgccgtctgaagcgtcgcaaatgttccacctcttgcaacgtcaagtcttgggttcataccgcaaaccgctggtgattttcatgtccaaacgcctgttgcgcttcaaaggtgcaatgagcccgctggaaaacttcaccgaaggttcgaccttccgtccggttatcggcgataccgcagaacgcgcaagcaacgacagcgtgaaacgcgtggtattgtgtgccggtcaggtttactatgacttggaagccggccgtgccgagcgtaaactggaagatgatgttgctattgtccgcgttgagcagctgtatccgttcccatatgacgaggttaaagctgaactggcgaaatatccgaacgcaaaatctgtggtttgggcacaagaagagccgaaaaaccaaggcgcgttctaccaaatccgccaccgcatcgaagatgttattagcgaagagcaaaaactgtcttatgccggtcgtccaagcagcgcatcgcctgcagtgggctactcaagcaaacacattgctcaattgaaacaattggttgaagacgctttggcattgtaaaccaagtagcattccgtctgagtctgctcagatggaatgcccatatgcagaattaaaaacacacaacaggccgtctgaaagggccattggagacacaaaatgattattgatgtaaaagtacctatgttgtctgaaagcgtatctgaaggcacgctcttggaatggaagaaaaaagttggcgaagccgttgcccgtgacgaaatcctgatcgatatcgaaacggacaaagtggttttggaagtaccttctccacaagccggcgtattggttgaaatcgtagctcaagacggtgaaaccgttgttgccgaccaagttttggcgcgcgtcgatacagctgctactgccgctgctgaagccccagccgccgctcctgcagaagctgccccagctgccgctcctgctgctacacaaaacaacgccgctatgcctgctgccgccaaactggctgccgagaccggtgttgacgtgaacgcattgcaaggttccggccgtgacggtcgcgtattgaaagaagacgtacaaaatgccgctgccaaacctgccggagccgctgctcctgctgttgcacttcctgccggcgcacgtcctgaagaacgcgtaccaatgagccgcctgcgtgcccgtgttgcagaacgcctcttggcttctcaacaagaaaacgccattctgactacattcaacgaagtcaacatgaaaccaatcatggacttgcgtgcgaagtacaaagaaaaattcgagaaagaacacggcgtgaaactgggctttatgtccttcttcgttaaagccgctgttgccgccctgaaaaaatacccggttgtgaatgcttctgttgacggcaaagacatcgtgtaccacggctacttcgacatcggtatcgcaattggcagcccacgcggtttggttgtgccaattctgcgtgatgccgaccaaatgagcattgccgacatcgaacaagcaattgttgattacgcgaaaaaagccaaagacggcaaaatcgctatcgaagatctgaccggcggtacattcagtattaccaacggcggtactttcggttctatgatgtctaccccgatcatcaacccacctcaatctgcgattttgggtatgcacgccactaaagagcgcgctgtggttgaaaacggccaagttgttgtccgtccgatgatgtatctggctctgtcttacgaccaccgtatcattgacggccgcgaagctgtattgaccttggtagccattaaagacgcgttggaagacccggcccgcctgttgttggatctgtaatcgtttcagacggccttttatttgttaatgaaaaggccgtctgaatttttatagtggattaaatttaaaccagtacggcgttgcctcgccttgccgtactatctgtactgtctgcggcttcgtcgccttgtcctgatttaaatttaatccactatatttagatgtagcgtaatgtagtatcgtgctacaataggctcaacgaacgattgaggccgtctgaaacatttgattcgaatgaatcggcagatatggactttcagacggccttttcttaaaaccatcaaaacgcagtcattcaaaataaaaaagaaacaaaaagtatcgtttttattttgagatactgttaaaagcaaaggatgacacgatgtctcaatatgatgtagtagtgattggtgcaggcccgggtggatacgttgccgccatccgtgccgcgcaactgggtttcaaaaccgcttgcgtcgatgcaggcgttaacaaagcaggcaatgcccctgcattgggcggtacttgcttgaacgtaggctgtatcccttctaaagccctgttgcaatccagcgaacatttccacgctgcgcaacacgagtttgccgaacacggtatcactgtcggcgacgtaaaattcgacgcggccaaaatgattgagcgcaaagatgccatcgtgaccaagctgaccggcggcgtcaaattcctgttccaaaaaaataaagtaaccagcctgttcggtacggcttcctttgccggtaaaaatggcgatgcttaccaaatcgaagtcgataacaaaggcgagaaaaccgttatcgaagccaaacacgtcatcgtagccaccggttccgtaccgcgtccgctgccacaagtcgctatcgacaatgtgaacgtattggacaacgaaggtgcattgaacctgaccgaagtacctgccaaactcggcgtgatcggttccggcgtgattggtttggaaatgggttccgtatggaaccgcgtgggtgcggaagttaccattcttgaagccgcgccgactttcctggctgccgccgaccaacaaatcgccaaagaagccttcaaatacttcaccaaagagcaaggtctgagcatcgaattgggcgtgaaaatcggcgacatcaagtctgaaggcaaaggtgtttccgttgcttacgaaactgctgctggcgaagccaaaaccgaagtattcgacaaactgatcgttgccatcggccgtattccaaacaccaaaggcctgaacgcggaagccgtaggcttggaaaaagacgagcgcggctttatcaaagtagatggcgaatgccgtaccaacctgcctaacgtatgggcaatcggcgacgtggttcgcggcccgatgttggcacacaaagccagcgacgaaggcgttgccgttgccgaacgcattgccggtcaaaaaccgcatatcgacttcaacaacgtaccgttcgtgatttacaccgatcctgaaatcgcttgggtgggtaaaaccgaagagcagctcaaagccgaaggcgtggagtacaaaaaaggtacttcaggttttggtgcgaatggtcgcgcattggcaatgggcaaagccaaaggtacggttaaagtgttggcagatgccaaaaccgaccgcatcttgggcgtacacatgattggtccggttgtcagcgaattggttaccgaaggcgtgactgcgctcgaattcttcgccagcagcgaagacatcgcccgcattatccatgcccacccaaccttgtccgaagtggttcacgaagctgcattggcggccgacaaacgcgctttgcacggttgatagacattaaggccgtctgaaatttttcagacggccttaaggccttcgacaaattgaatgttccgagagctccgttttctgatttataattccgtcagacaaacaaacagcatttacattcattatgaacaaagaaatagtcggtattttctttataccggcgggcatcatcagcatgtgtatggccgcattgtggcagatgtatgtgatgatgaccgaaacttatacgctcaaccgtttcaaagataaagaattggtttggcgcgtggcattgttgtttatcagtttcagccttgccgtttatctgctctgtccgaattcgcgtaaaaaaggcatcgtcttttttattctcgggggaggcggtgcagccatgtatctgctggcgcggatgtggttgcctttcagcaagtgaaacgacgattttccgaccgccgaaaggtagtctgaaacgcacgggcttgccatttggaggcagactcggggcattccactaatctaaaggagaaatccatgaatttacacgagtatcaggctaaagaactgctggctagctacggtttgcccgtacaaggcggtattttggcacacaacggcgaagaagccgctgcagcttacgacaaattgggcggcaaattcgctgttgtcaaagcacaagtacacgccggcggccgcggtaaagcgggcggcgtaaaagtcgttaaaagccgcgaagaagctaaagaagtggctgaaagcctgattggcaccaacttggtaacttaccaaaccgatgccaacggccaacctgtcaacagtgttttggtttgcgaagacatgtatccggttcaaaccgagctgtacttgggcgcagtggttgaccgttctacccgccgcattacattcatggcctctaccgaaggcggcgtggaaatcgaaaaagttgctgccgaaactcctgaaaaaatcttcaaagtaaccgttgatccgctggtcggcctgcaaccttgccaagctcgcgaagttgcgttccaactgggcttgaaagacaaacaaatcaacgagttcgtcaaactgatgaccggtgcgtacaaagcgtttgtcgaaaatgacttcgccctgtttgaagtcaacccgctggcagttcgcgaaaacggcgcgctcgcctgcgtggacggcaaaatcggcatcgacagcaacgcgctctaccgcctgccgaaaatcgccgaattgcgcgacaaatctcaagaaaacgaacgcgagttgaaagcttctgaatttgacctgaactatgttgccctggaaggcaacatcggctgtatggtgaacggtgccggtttggcgatggccactatggacatcatcaaactgaaaggcggccaacctgccaacttcttggacgttggcggcggcgcaaccaaagaccgcgtggttgaagcgttcaaactgattctggaagacaaatccgttcaaggcgtattgatcaacatcttcggcggtatcgtacgttgcgacatgattgcggaagccatcgtggcagccgttaaagaaatcaacgtcaacgttcctgtcgttgttcgtttggaaggcaacaacgccgaactcggcgcgaaaatcctgaacgaatcaggtctgaaactgacttctgcagacggcctgaatgacgcagccgaaaaaattgttgcagccgtaaacgcctaaggagaaaagaatgagcgtattgattaataaagacactaaagtattggttcaaggtttcaccggtaaaaacggtactttccactccgaacaagctctggcttacggcactaaagttgtcggcggcgttaccccgggcaaaggcggtcaaacccacctgaacctgcccgtgttcaacaccatgaaagaagccgttaaagaaaccggcgcggatgcatccgtgatttacgttcctgctccgtttgtgttggattctatcgttgaagcagttgattcaggcgtaggcttggtcgttgtgattaccgaaggcgtgccgactttggacatgctcaaagccaaacgctacttggaaaccaacggtaacggaacacgtttggtcggccctaactgcccgggcgtgattactccgggcgagtgcaaaatcggcattatgccgggccacatccatactcccggccgcatcggcatcatttcccgttccggtacattgacttacgaagccgtggcacaaaccaccaaactgggcttgggtcaatcaacctgtatcggtatcggcggcgacccgattccgggtatgaaccaaatcgacgcactgaaacttttccaagaagacccggataccgacgccatcatcatgatcggtgaaattggcggtactgcggaagaagaagcagccgaatacatccaatccaacgtaagcaaacctgttgtcggctatatcgccggtgttaccgcacctaaaggcaaacgcatgggtcacgccggtgcgattatctccggcggcaaaggtactgcggaagaaaaattcgccgctttcgaaaaagccggtatcgcttacacccgcagccctgccgagttgggcactaccatgctggaagtgttgaaagcaaaaggtttggcataatcaggtttgacaactgattgaacatcaaatgccgtctgaaaccggaaatcgggtttcagacggcattttgtttgtcatttcaaaaagaggcagcctcaacatacccacattatttttgcccttttggggcagtcagagacctttgcaaaattccccaaaatcccctaaattccctaaattcccaccaagacatttaggggattttggggaattttgcaaaggtctcgggctaagtgtgcctgtttgcgcctaaaaggcggcccggatgcctgattatcgggtatcctgggaggattaagggggtattggggtaaaattagtggatatttgaaacgaaaacagccgaaaacctgtgtttgggtttcggctgtcgggagggaaaggaattttgcaaagctctcgtattggctttgaagttccgtgtaattcacaggtagggcgtgtggcacagccacgcacgcggtcggttgggtatgcaggctacggctttctctgttgaaactgcaacacgtcagctaccaaccgtgtgcgtagcgcacacggttggttgggatacaagttactgtttgttcttaaatggagtaccaacatcaagggcttttgataatcctgaaaatattaaatattcagtttcagtttttattttaggagaaatatttgcataatttctatctttaaagcaccaatggatatatggtttcgtttcatcttctgggttatctaaataagcaataacattcaagtcaaataaaaattgcaaaaactcattagcagtactcataaatttaggtatttccactgatgttgtttgtaagtgctttttcaaacgttcaaatgcttttaaaaaatcactatatttaaatctatctttcccgtttaaaaattcaaaaaatttcaggaaattttgataatcactttgactataataaaacaaaagatgatctttgatttcaccaagtaaatatatcgagtattctctttgaaaagaagtattatcaaaatcttctgctacgacataatcttccttacttttcttatttttttgtagcaaagtaagcatctgaagaatatcgcgaggtcgataatacgattttcttaggaagctaataaatgaagttaaatttttatactcatcatgtaaattaggagcattccatggaaaataataatcccatgagttgcctttttctaaactatcttgtttttcttgctgggttctcaaaagatgatcaaaaacgccaaaaatctttgaacttctataagatttataatccgtcctccagtctaaaaatactgaattatcttgaagtttggtattttgattttgtaaacctaatgaatcaaagatatcaggtctaatcaataacacaactctcatccttcccttactatctttaatggaagggaagatatcattatttaacatccatatggcgttagcaagaccttttacacactcatgatattcatcaaatggaatctgtgatggtctaatatctatcccatcaataaacaaaatatgattatcttttagctttaactgagataaagcatctttaaattttctttcaataaaacctaaatttgcttggaatttactttctgtaaaagttatttgttgggattcctcttcacctagtttaacaaattttccaaaaatcatttccgcagcttcttttgaattttctattaaagttattgcttgtacaatttccggatcaaaagcgccataataatattcatttatagcctcatctaaggctttaaatttattaaatattgaagataatattccgttttctttacatttgatttgatttgatatcaacagatataaaatgactttccaaatacttgtaaaatctgaaacagttaagtgtcttgctttctttagctgaataaattttgaataatcggtttcacgaacaaacttagtagtggcatgtatgtttttatagaagttattagttaaataaacagcatatgctgtctttccagttcccttttctccgattaaaaacgaaatatttggttcacataattcatccaaatattctccttttacaaatattcggttaaataaatctttattttctcttcttctgtagtttgcagcatccacaaatccaaattctaatgtttttaacggtttcatcttaataatctcctatttaattttgaattaaacttacctcaaaaccaccttcaaatacttcccagtataactccccttaactttcgccacctgttcaggactacctttagcaataatcctccccccgccatctccgccttccggccccaagtccacaatccaatccgctgttttaatcacatccagattatgctcgataatcactatcgagttgcctttgcctttcagacggcctatgacttccagcagcagggcgatgtcggcgaagtgcaggccggtggtgggttcgtcgaggatgtagagcgttctgccggtgtcgcgtttggagagttccaaggcgagtttcacgcgttgggcttcgccgccggagagggtggtggcggactgtccgaggcggatatagcctaggcctacgtccatcagggtttgcagtttgcgcgatacggtggggacggcgtcgaaaaattcgcgggcttcttcgacggtcatgtcgaggacttggctgatgtttttgcctttgtattggatttcgagcgtttcgcggttgtagcgtttgccgtggcagacttcgcaggggacgtacacgtcgggcaggaagtgcatttcgactttaatcacgccgtcgccttggcaggcttcgcagcggccgcctttgacattgaaggagaatctgccgacgttgtagccgcgttcgcgagagagggggacgccggcgaagagttcgcggataggggtgaacaggccggtgtaggtggcggggttggagcgaggagtacggccgatgggggactgatcgacgttgatgactttgtcgaggtgttcgaggccgtggatgtcgtcgaatggggcgggttcttcttgggcgcggttgagttcgcgggcggtaattttggcgagggtgtcgttaatcagggtggatttgccgctgccggacacgccggtgatgcaggtaatcaaaccgagcggcagctcaagggtaacgtttttgagattgttgccgcgtgcgcctttgaggacgagcatccggtcgggattgacgggcgtgcgttcagacggcacggcaatggattttttgccgctgaggtattgtccggtaacggagttttcgcattgggcgacgttttcgggcgtgtcggcaatcagtacgttgcctccgtgttcgcctgcgccggggcccatatcgaccacgaaatcggcttcgcggatggcgtcttcgtcgtgttcgaccacaatcacgctgttgcccaaatcgcgcaggcgtttgagggtggccagcaggcggtcattgtcacgctggtgcaggccgatggagggttcgtccagtacatacatcacgccggtcaggccgctgccgatttggctggcgaggcggatgcgctgggcttcgccgccggagagggtttcggcggagcggcttaaattcaggtaatccagcccgacgttaatcaggaagccgaggcgttcggtgatttctttgaggattttttcggcgatttgttttttgttgccgtctaaatccagtgtttcaaagaattggtgggttttggtgagcggccaggcggaaacttcgtgcaacggctcaccgctgacgtaaacgtagcgggcttctttgcgcaaacgtgcgccgccgcagcttgggcaggcgcggtggttttggtattcgcgcagtttttcgcgcacggtttcgctgtcggtttcgcggtagcggcgttcgagattggggatgatgccttcaaaggcgtggctgcggttgaaggtggtgccgcgttcggacaggtaagtgaaatcaatgacttctttgcctgagccgtgcagcacaacttttttcactttttcaggtagtgtttcccaagcagcctgcacatcgaaaccgtaatgccgcgccaatgattgaatcatttggaaatagaattggttgcgcttgtcccaaccgtcaatcgcacctgttgccagcgacaattcgggatgggcgaccactttttcggggtcgaagaaattggtgttgcccaagccgtcgcaagtcgggcaggaacccatcgggttgttgaacgaaaaaaggcgaggctctaattcgggcaggctgtacgaacacacggggcaggcgaaacgtgcggaaaaccaatgttcttcgccgctgtccatctccatcgccagcgcacgctcgttgccgtggcgcagcgcggtttcaaaactttccgccagccgctgcttgatgtccgccttcactttcacgcggtcgatgaccacgtcgatattgtgcttgatgtttttttccagcttcggcacttcgtccaactgatagacctcgccgtccacgcgcacccgcgcaaaaccctgcgcctgcaagtcggcaaagaaatcgacaaactcgcccttacgctcgcgcacggtgggggcaagaatcatcacacgcgtgtcttccggcagtttcaatacggcatcgaccatctgcgatacggtttggctcgacagcggcagcttgtgttcgggacaatacggggtaccgacacgggcgtataaaagacgcagatagtcgtggatttcagttaccgtaccgacggtggagcgtgggttgtggctggtggatttttgctcgatggaaattgcaggcgacagaccttcaattaaatcgacatcgggtttgtccatcatctgcaaaaactgccgcgcataggcggaaaggctctcgacataacgccgttgcccttcggcatacagcgtgtcaaacgccagcgacgacttgccgctgcccgacaatcctgttaccaccacgagtttgtggcgcggaatgtctaaatcgatgtttttcaaattatgcgtgcgcgcgccgcggatgcggatggtgtcgttgtcgtgcgaatgttggggatgatggttgcacataatggatgccgcctgaaaaataaaggaaaaccggtattgtagcactttctcggatgccgtctgaagccgcgttcagacggcatttgccagcggagtacggcagattccgctataatgtcggcaattttaacccgcttgaacaaaaggatgacaaatgaaccgtctttacccccacccgattatcgcccgtgagggctggccgattattggcggcggtttggctttgagcctgctggtgtcgatatgttgcggctggtggtctttgccgttttgggtgtttaccgtatttgcattgcagtttttccgcgaccctgcgcgtgagattccgctaaatcctgaagcggtgttgagcccggttgacggccgtatcgtggtggtcgaacgcgcacgcgatccgtatcgtgatgtcgatgctttgaaaatcagtatttttatgaacgtgttcaacgtgcattcgcaaaaatcgcctgccgattgtacggtaacgaaagtggtctataacaaaggcaaattcgtgaatgcggatttggacaaagccagcacggaaaacgaacgtaatgcggtgttggcgactacggcttcaggtcgtgaaattacttttgttcaagtggccggtttggtggcgcgccgtattttgtgctacacccaagcaggtgcgaaactgtcccgcggcgaacgttatggctttatccgcttcggttcgcgcgtggatatgtatctgcctgtcgatgcgcaggcgcaagtggcgattggcgataaagtaaccggcgtcagcactgtattggcgcgtttgccgctgactgcgccgcaaactgaatctgagcctgaatctgagcctgctttacaaactgctccggttgaaacagcggcaaacccatctgccgaacaacggcaaatcgaggcagcggcggctaagattcaggcggctgtgcaagatgtgttgaaagattaattttgcggactgaaatagaaaatatcagtaccatcattcacacgaatgaggaagtttggttttttgaatttttgctaatgttcacaccgtcattcccacgaaagtgggaatctagaaacttaacgttacgacgatttatcggaaacgactgaaaccggacggactggattcccgcctgcgcgggaatgacgacttattagttacctaacacttaaaaaacagaaacctttccgcgtcattcccacgaaagtgggaatccgggaacttaacgttacagcgatttatcggaaacggctgaaaccgaacgaattggattcccgcctgcgcgggaatgacaactcattagttacctaaaacttaaaaaacggaaacctttacgccgtcattcccacgaaagtgggaatccgggaacttaacgttacagtgatttatcggaaacggctgaaaccgaacgaattggattcccgcctgcgcgggaatgacaactcattagttacctaaaacttaaaaaacagaaacctttacgccgtcattcccacgaaagtgggaatctagaacccaaatgctaaggcgatttatcggaaacggctgaaaccgaatgaattggattcccgcctgcgcaggaatgacaactcattagttacctaaaacttaaaaaacagaaacctttacaccgtcattcccacgaaagtgggaatctagaacccaaatgctaaggcgatttatcggaaacggctgaaaccgaatgaattggattctcgcctgcgcgggaatgacgacccattagttacctaaaatttaaaaaacagaaacctttccgcgtcattcccatgaaagtgggaatctagaacccaaatgctaaggcgatttatcggaaacggctgaaaccgaacgaattggattcccgcctgcgcgggaatgacgggatcttgggtttctgcttttgatttttctgcttttgcgagaatgacggcgtgaaagtaagaatgatgaaacaaaaaaaatgggaatgatggcatagtggtttgttctttgtctttgccatatttcctaacaaattgattaaaaagaaaaaaggttttcagaatgccgtctgaaaaccttttttgtttgcctgtccgattttaaaacttcacgttcacgccgccggtaaagctgcggcccatttgcggcgtatcagagagaaagctgctgtgggcgtaaacggattggttgagcaggttgtcggctttgacgtaccaattccactcgccatagcgcgtattgcggcggtagtttgcgccgaggttgagcatatggtgtccgggcgtgcgcgtttcgtagcgggcgagtttgttttgggcgaacacgcggtagtagtccaaattggcatcgatacggtcggtcagcgaggctttcaggtggaagccgaggcgcgcagccggaacacggggggcattttggtcgtcctgtgcgatgaaaggacggttgccgtaggcatcttctctgccgggtagggaaggcaggtttttcagacggcctcgtacatagtcgccggaaacgccgatgcggtagcgcggtgtcggtttgaagtagatttcgccttccgcgccgtagaagtcggcgccggattggttgtagcgcacgagcttcatttcgctgtcgtcttcgatggatttggggccgcgtccgtcgtttaaggtttgggcgtaaatgtagttaccgaagcggttgcggtagagtgccagattgtattgccagcggtcgccttcgtagcccagcgcgagttcgatattgttggaacgctctttgttgaggtgtttgttgccgacttcaaaggtgttggtggcgacgtgtttgccgtgtgcgtacagctcttgcgttgacggcaggcgttcctgatgggaggcggtcaggctgagtttgtgttgtggcgtgaaataccagttgcccgaaagtgcgaatgagcgggcggtttggcggtgcgcgccgaggtcgggcagggggtggttgtagtagttttcccgatcaatcaatgctttgtcgtactgaatggaggctttttgtttttccacgcgtacgcctccttcaagcgtgaagttgtcccagtttgcctgttctacaccgaaaaagctgtaatgttgcactttgttgtcaagcagcatcggttgtttaaccgcttcggatatggcagataaagcactggatttttgttgtaaatattgcacgccccagctgcctttcagacgacctatgggttggtggcgcaactcgatgcgggcgttttgcgtttggttgttaaaaaagttttcgactgcatcgcctgctttttcgtcgtggcggtagtcgttgcggttcaggtgtacgcgcagggcttcaaaaccggggaacggttgcttccattcggcacggagttcgtagcgtttgttgcgcaggtctatccacggtctgccgctgtgggtgtgtgcgtgtgcattatcgtcgtcgtggaagccgcagctcaagcccggattgtcgtaatcgatgtcttcttcggtcaacaggtgcggataaagctgtaaatagcgtttgttaatcaagctcttttgccagatgatgtcggcgtggcaatcatcgtattcgtggctgtgggcaggcagaccatattggtcgcgacggtcgctgtacgctacgccgataaaacctttttcgccaacccaagacagcccgatgctgcccgtttgcgaatcggcgtggctgtcgggcaggcgtttcagattgcggtaacgcggtacggcgtaatcccccgatttgcggtacagcccttccgtgtgcaatacaaagtttttgcccaaaccgatattgatgccgccggacgtgagtttttccagattgccgctgctcaaacgcaatccgagttcgcccgatacgccgttttcaggcattttttcggggattttgccatcggcaacatcgaccagccccgccacattgcccgagctgtacaagagcgtaaccggcccgcgcaggatttcgacctgttgcgacaaggcggtatctaccataatggcgtgatcgggcgaaaaatccgccatatcgcctgtttcgccgtgatggttcaacactttaatccgcctgcctgtttgaccgcgaatgacgggagcagacgcgccgccgccgtattgcgaagcgtggatgcccggtacgccgtctaaagcgtcgcccaagttgacggctttttggcgcaaggtatcgccggagatgattttgtcggaggcggtcgaagtgtgcaacagccccgacgtggcgcgcggacggcttttgccgacgacgctgaccgtttccaaatccaccgattgctcagttttatgcgg

SEQ ID NO: 37813 - DNA, 48275 bp, Neisseria meningitidis
tagtggattaacaaaaaccagtacggcgttgcctcgccttagctcaaagagaacgactctctaaggtgctgaagcaccaagtgaatcggttccgtactatctgtactgtctgcggcttcgtcgccttgtcctgatttttgttaatccactatatcgatttgaatttttcagaaaatgaagcggacgtttgggcggaggcaacttgtttgataagatagcaatattttaaaacggagaaagatcatgccttatgtcaatattaaagtaaccggcggcaaggaagcaccgactgccgcgcaaaaagcggaactgatcggcggcgtaaccgaattgctggcacgcgtgctgggcaaaaatcccgaaacaacggttgtcgtgattgacgaagtggataccgataactggggaataggcggcaaaagcgtcagcgaacggcgcaaagagggcaggtaaaaagcctgaaaatctcggtttgatgctttaaattccgcgtgaaaaagagtacattcccacccattgcccaaaatttacggaacacatcatggataaatttcccaagtctgcaaagctcgatcacgtctgttacgacatacgcgggccggttcacaaaaaagcccttcagttggaagaggagggcaataaaatccttaaactcaatatcggcaaccctgcgccgttcggctttgaagcccctgatgaaatcttggtcgatgtcatccgcaacctgccgacttcgcaaggctattgcgattctaaagggctgtattccgcccgcaaagccattgttcactactatcagaccaaaggtttgcgcgatattacggttgatgatgtctatatcggcaacggcgtgtccgagctgattacgatgtctatgcaggcattgctcaacgacggcgacgaaatcctgattcccgcgcccgactatcccttgtggacggcggcggcaacgcttgcgggcggtacggtacgccattatctgtgcgacgaagaaaacggctggttccccaaccttgccgatatggaagccaaaatcacgcccaaaaccaaagccatcgtcgtcatcaatcccaataatccgacaggcgcggtgtacagcagggaaatcctgttggaaatcgccgaactggcgcgcaagcacggtttgattattttcgccgacgagatttacgacaaaatcctttatgacggcgcggttcaccaccacatcgccgcgcttgcccccgaccttttgacggtaacgttcaacggtttgtccaaagcctaccgtgtagccggattccgccaaggctggatggtgctcaacgggccgaaacatcatgcaaaaggttacatcgagggtttggatatgctctcgtctatgcgcctgtgtgccaatacgccgatgcagcacgcgattcagacggcattgggcggctatcagagcatcaacgaattcattttgcccggcggacggcttttggaacagcgcaacagggcgtgggaactggtcaaccagattcccggcgtatcctgcgtcaaaccgatgggcgcgatgtatatgttcccaaaaatcgataccgaaatgtaccgtatccgcgatgacatgaaattcgtttacgatttgctggtgcgcgaaaaagtcttgctggtgcagggaacggggtttaattggatcaagcccgaccatttccgcattgttacgctgccttacgtccatcagattgaagaggcgatgggcaggctggcaagattcctgcaaacctaccgccaataaggggacggtttgtctgccgaggataaaaaatgccgtctgaaacggagattcccgtttcagacggcattttcaacagcaggaacgaatcaggcaaatttcagtctgtcgccgtcggcttccaccctgatttcgctttcgggcgcatagtttccggcaagcagggcttttgccagcgggttttcgatttccgactggatggcgcgtttgagcggacgtgcgccgtaaatcgggtcgaaaccggctttggcgatgatgtccagtgcggcatcggaaacagccaggcgcaggttttgtttttccaaacgtttttccaagcctttgagctggattttcgcaatgttgcggatattatcctgatccagtccgtggaacacgaccacttcgtcgatgcggttgatcatttcggggcggaaatgttctttcacatcctccatcacaacttctttcaccgcttcgtaatcctgaatgcccatttgttggatatgttggctaccaatattggaagtcatcacgataacggtatttttgaagtccacggtgcgaccttgtccgtcggtcaagcggccgtcatccaatacttgcagcaggatgttgaacacatcgggatgggctttttccacttcgtccagcagaatcacgctgtacggtttgcggcgcacttgttcggtcaggtagccgccttcttcgtagccgacatagcccggaggcgcgccgattaagcgggcaacggcgtgtttttccatatattcggacatatcgatgcgaatcagatgatcttcgctgtcgaacagaaagcctgccagggctttacacaactcggttttacccacgccggtcgggcccaagaacaggaagctgccgtaaggcttgttcggatcggcaagaccggagcggctgcggcggatagcgtcggacacggcacgcacggcttcgtcctgtccgaccacgcggcggtgcaatacttcttccattttcagcagtttgtcgcgttcgccttccatcattttggatacgggaatgccggtcatacgggaaaccacctctgcgatttcctctgcgccgacattattacgcaagagtttgtttgccggttttgtgctgtccgtatctgcccgttcggcggctgcacgctgtttttccaaatgctccaaatcttcatacatcaattttgaagccagtgccaaatcgccttgccgttttgcctgttcgattttaattttgacttcgtcaatttgtttcttaatattagcagcaccgtctgaaattgctttttcggctttccagatttcgtctaaatcggcgtattctttttgcagaccgttgatttcctcgtctatcagttccaaacgttttttgctggcatcgtctttttctttttcaacgtgcgccttttccatccgaagctgaattagacggcggtcgattttgtccattgcttccggcttggtttctttttccatcttgacacggctggcggcttcgtcaatcaaatcaatcgctttatcgggcaggaagcggtcggtaatgtagcggtcgctcaactccgctgcggcaacgatagcagggtcggtaatatcgataccatggtggatttcataacgctcctgtaaaccgcgcaaaatagcgatggtgtcttccacgcttggctcgccaaccaatactttttggaagcggcgttcgagtgccgcatctttttcgatgtattggcggtattcgtccaaagtggtcgcgccgatacagtgcaattcgccacgtgccaaagccggtttcagcatattgcccgcgtccatcgcgccgtcggttttgcccgcgccgaccaaagtatggatttcatcaatgaaaatcagagtgttgccgtcgtctttcgccaaatcgttcaacacgcctttcaagcgttcttcaaattcgccgcggtatttcgcgccggcaatcaaagccgccaaatccaaaaccagcaagcgtttgttacgcagggattcaggtacttcgccgttgacgatacgttgcgccaagccttcaacaatggcggttttacccacacccggctcaccaatcagcacagggttgtttttggtacggcgttgcaatacctgaatcgcgcggcggatttcgtcgtcacgaccgataacggggtcaagtttgccgtcgcgggcgcgctgggtcaggtcaagcgtatattttttcaaagcatcgcgttggtcttcggcattggcatcgttcacgttttgtcctcctcgtactgcgtcaatcgcggcattgatgttttgttcggtcgcgccggcttctttcaaaattttgccggtcgcatcgttctgctgtaccaaggcaagcaggaaaagttcgctggcaatataggcatcgctgcgtttggtggcagctttgtccatcaggttcaacaccgcctgcaattctcggctgggcagaatatcgccgccctgaccggacactttcggcaggctgtttaaatgctgctgcaaacgctgtttcacctgcggcacgttcacgcccgcatgagccaagagcgcggcggctccgctgttttggtcgtcaagcagggcttttaacacaaagcccgcttccagatagctgccgtccgcagccaacgccaaactctgagcttctgcaagggcttgttggaatttggcggttaatttgtcgtatcgcatttttgtttccttttcaaaatgtccgctgtcgaagcctatatgtgcataattgtggataactcaagttctgttttctgtttttctatatttaattcgatatatcattgaatttaaagtatataaaaatgtataataatgtgtataactatatcttcttaatatggaaaagtctgttgtcggctggatgtaggtggcaaatcgggtataatcggcacatctttttccctttcagacggcattgatgccgcaaggacatttttatgagcaaaaaacgagttctgaccggcgtaaccaccaccggcatcccgcatctgggcaactacgtcggcgccatccgccccgccgtccgcgcggcgcaaaacctcgataccgaatccttcctcttcctcgccgattaccacggtatcatcaaatgccacgagccggagatgattcaccaatccacccaagccgttgccgccacttggcttgcctgcggactcgaccccgagcgcaccaccttctaccgccaaagcgacactcccgaagtgatggaattgaactggattctgacctgcatcactgccaagggtttgatgaaccgcgcccatgcctacaaagccgccgtgcaggcaaatgcagaaaacgggcaggaagaccctgatttcggtgtggaaatgggtttgttcagttatccgattctgatgactgccgatattctgatgttcaacgccaacgaagtgcccgtcgggcgcgaccaaatccaacacgtcgaaatggcgcgcgacatcgccggccgcttcaaccaccgcttccgggaactcttcaccctgcccgaagtgaaaatcgatgaaaacgtcgaactcttggtcggtttggacggacgcaaaatgtccaaatcctacggcaacaccattccgctttgggaaaacgacaaaaaaacccaaaaatcggtcaacaaaatcatcaccaatatgaaagagccgggcgagccgaaacagcccgacgaaagcccattgtttgaaatctacaaagccttctccacgccgtctgaaacggtggaatttacgaaaatgcttgccgacggcttggcgtggggtgaagccaaaaaacttttggcggcgaaaatcaacgccgaactcgccgaaccgcgcgaacgctacaacgagctgaccgccgacccttcgcaaatcgaagagattttgcaggcaggcgcggcgaaagcgcgtaaagaagcacgcgaattattggacaaagtacgcgatgcggtcggcatccgcccgttgaaatgaacccgatgccgtccgaacctccgcctgccgcgtttcagacggcattttgaaaccatcaggagtgtggaatgctgaaaacatcttttgccgtattgggcggctgcctgctgcttgccgcctgcggcaaatccgaaaatacggcggaacagccgcaaaacgcggtacaaagcgcgccgaaaccggttttcaaagtcaaatatatcgacaatacggcgattgccggtttggatttgggacaaagcagcgaaggcaaaaccaacgacggcaaaaaacaaatcagttatccgattaaaggcttgccggaacaaaatgttatccgactgatcggcaagcatcccggcgacttggaagccgtcagcggcaaatgtatggaaaccgatgataaggacagtccggcaggttgggcagaaaacggcgtgtgccataccttgtttgccaaactggtgggcaatatcgccgaagacggcggcaaactgacggattacctagtttcgcatgccgccctgcaaccctatcaggcaggcaaaagcggctatgccgccgtgcagaacggacgctatgtgctggaaatcgacagcgaaggggcgttttatttccgccgccgccattattgaggtattcggacatcccggaatatatttgggtttttcaaaccctgcaggaaaaagtccgcaccgtcgggaaactcaaaaggagggggatatgtgttacaattttccgaactgttttcataaaatagttttcggacgtgtttcaatatggcattgatgccgccttattgttcgagaaaaaaacctttatatttaaatataatgggttttaactaaacgggaaaccgttttctctccggtcgatgggcaaaatcagccgattgatggaacacggtccgatttttaagcaaaaccttaatcaacaactcaagaaggataagacatgaaaaaattattgattgccgcaatgatggcggctgccttggcagcttgttcgcaagaagccaaacaggaggttaaggaagcggttcaagccgttgagtccgatgttaaagacactgcggcttctgccgccgagtctgccgcttctgccgtcgaagaagcgaaagaccaagtcaaagatgctgcggctgatgcaaaggcaagtgccgaggaagctgtaactgaagccaaagaagctgtaactgaagcagctaaagatactttgaacaaagctgccgacgcgactcaggaagcggcagacaaaatgaaagatgccgccaaataatttgttgccttggcaaaaatgatgggatgccgcctgccggcaacccaaacgaaaccgcctgaagattttcaggcggtttttgggttatgtgccccttgttttttacgcctgcatgaccgttccgagcagatgtgccgcgcatatcgggatgttgcggacaggcaaatgccgtctggacagggtttggacggcatttgttccgcaaggttcagacggcctcgactttgaacggcatattgattttttgccattggacgctttcatattccaatgcgtcggcaatcaggggatggcgttccagccattccctgtcaatacgcaggatgaagccgcagctttccgtatccgtgcgcaactgcatatttttcgggaaagacaggtcttggcgcgaacggcagaacagtgcggcaaggcgcagggacaaaacggcataccacaacatttcgttggtgccgatgatgccgctcatttttttcatatcgccgcgatgaccgatgaccagttgggcaagtatggtctgttctttgcgtgagaaacccggcatatcggcgttttcgaggatgtaggcggaatgcttgtgatagccggtgtgggcgatgtccaaaccgatttcgtgcagcgcggcggcgcgtccgagatactgttgccacaaggcaagctcttgaactgtaacgtttttagcgtggcagaggctgtccataaaggtttgcgcggtctcggcggtgcgtttcgcctgattgaggctgacgtggtagcggtgttggaactcggcaaccgtttgtccgcgcatatcttcgtttaaaccgcgcccgatcaaatcgtaaaacacgccgtcgcgcagggcggcttcggttacggtcatcctgtcgagtttcatttcctcaaacgccgccatcatcacggcaagtccgccggcaaaaacttcgatgcgttccggtttcaggttttcaaatttggcttttttgaccgaaccggcttcgatgatgcgttcggcgagggcgcgcatgcctttgtaggtaatgtccgcctcttggggcatttcggcggcaagcacgtcgcggatggattttgccgaacccgatgtgccgacggcgaaatcccaaccttcgcgcctcatatttttgctgatacgctggatttcgttgcgggcggcggaaatggcagattggaagtctttggcggtgattttgttttggaagaagcgcaggctgtaggttacgcagcccaagggcaggctttcggtaatgtcgggattcagcgtcgagccgatgacaaattctgtcgaaccgccgccgatgtcgataaccagcattttgccgccgcccggggggagggtgtggatcacgccggtataaatcagccgcgcctcttcgcgcccggcgatgatttcgatggggaaacccaatgccgcttcggctttgggaaggaaatctgcgatgtttttggcaacgcggaatgtgttggttgccacggcgcgtacctgttcagggcggaagccgcgcaggcgttcgccgaattttgccagacagtccaaagcctgttcttgggaagcggcactcagatttttctgttcgtccagtccggcggcgaagcgcaccatctgtttgaacgaatcgatgacttttaattgtccgttgttgttttcgcaaatctggaggcggaaactgttggaacccaaatcgacggaggcgaggacgtttgcgggggtggtggtcatggcggataccggtgggggaaaaacgcaatgttactctgacggcgcaggcgttgacaataaatgatgcggcggtttttgattctgcccacggatgttgccgacggcattttttgcgcttatttgaaatccttttccacgctcatgaaaatctgcatgtttttgcgtgtgtaaaaacttttcatattgctgtcgattttcagatagcggaaattgagttgcggcgtaaagcccttccaagagattttgtcatgccacaacgacaggtttgcctgatattcgtggtctttgcgcgggaagcggtacacaatggtcccgggtgcgtcaaacatcctgcgggtatagcgcaggtttgcccgcagacccaagccgccgtcgaacgttttgaccgcgccgacacgcaaacccttgcggatggaagcctgttccgcctctttcgttatgttgtgcgaccagtccgcaccgccgtaaagcagccagtctttcggcgcggaatacatcagcgtcgcgcccgccagcggcatatggctgtcgtatcgggcggcggtgcggtcttcctgataatgcttccacatattgcccgcgtttagtgtcaaccgccagcgttcgctcaagcgttgggagaaatcggcattgaagccgccgacgaaattgtatcggctgccgcctaagaggttttgctcgacaaacggcacgatgccgaacgagcgcgttaccgaacggtttttatagccgaacgacaggcgcaggctctgttcgctgaaatctttgttatcccaataatgcacgccgccgccgctgatgccgccgtagaggaaatgatgcctgcccgcattgatttcgcgcgacacgcctaagccctagcgcaaaccgtgtgccttttgcggcaggctgtcggcggttttcgtccagcttctgcccgcaaattcaatcgttttttcggacgaagcgttgtttatagcggattaacaaaaatcaggacaaggcaacgaagccgcagacagtacaaatagtacggaaccgattcacttggtgcttcagcaccttagagaatcgttctcttttttgttcatccgctatattgtgttgaaacatcgccacaaacctgatatagtccgctcctgcaacatcattgaaaatctttctttttaatcagttaaaaccgaatacggagccgaaaatgaatccagcccccaaaaaaccttctcttctcttctcttctcttctcttctcttctcttctcttctcttctcttctcttctcttctcttccgcagcgcaggcggcaagtgaagacggcagccgcagcccgtattatgtgcaggcggatttagcttatgccgccgaacgcattacccacgattatccgaaagcaaccggtgcaaacaacacaagcacagtaagcgattatttcagaaacatccgtgcgcattccatccacccccgggtgtcggtcggctacgatttcggcggctggaggatagcggcagattatgccagttacagaaaatggaacaacaataaatattccgtaaacacaaaagagttgcaaaaaaacaatagcagtggcatctggcaagaactgaagacggaaaatcaggaaaacggtacattccacgccgcttcttctctcggcttatccgccatttacgatttcaaactcaacgataaattcgataaattcaaaccctatatcggtgcgcgcgtcgcctacggacacgttaaacatcaggttcattcggtgagaaaagaaaccacgactactttcagtccaccagcgcaaggcgctacagtgccaggcaaaatcgtacaaggtccgaccaacaaacctgcctatcacgaaagcaacagtatcagcagcttaggtcttggtgtcatcgccggtgtcggtttcgacatcacacccaagctgactttagacaccggataccgttaccacaactggggacgcttggaaaacacccgcttcaaaacccacgaagtctcattgggcatgcgctaccacttctgattccccgacaccgatgccgtctgaaccttcagacggcatttttgattcacctgccgtttacaggcgcggggcgggcgtggaaatacccgaaccgtcattcccgacaacaccgtaatcttgaaacccgccattcccgacaataccgcaatctcgaaattcgtcattcccgataataccgcaatctcgaaattcgtcattcccgcgcaggcgggaatccagactccctgacgcggcgggaatctatcggaaatgactgaaaccccgggattctagattcccactttcgtgggaatgacgtggtgcaggtttccgtatggatggattcgtcattcccgacaataccgcaatcttgaaacccatcattcccgcgcaggcgggaatctagaccccctgacgcggcgggaatctatcggaaatgactgaacccccgagattctagattcccactgtcgtgggaatgacggttcagttgcgttccgacaacaccgcaatctcgaaacccgtcattcccgcgcaggcgggaatctagacccccgacgcggcgggaatctatcggaaatgactgaaaccccgggattctagattcccacttccgtgggaatgacgtggtgcaggtttccgtatggatggattcgtcattcccgacaacaccgcaatcttgaaacccgtcattcccgacaacactgcaatcttgaaacccgtcattcccgcgcaggcgggaatccagaccccctgacgcggcgggaatctatcggaaatgactgaaaccccgagattctagattcccactttcgtgggaatgacggttcagcaagcgtaggtcggatacttgtatccgacaaaacctttaacattcccatcattgcaatccattgcagcaatgcccaaaatgtcgaattcaagaatccgacctacaaaatcattccgagcataatactatgaaataccgtcgtttttaccgcaatggcggcacttacttttttacggttgtaaccaataaacggcagaagattttgaccgatgatgcggtgcgtttggctttacggcaggcggtaatggcggtgcgcgaacggtatccgtttgaaattttggcatgggtgttgatgcccgaccatctgcataccatatggcggctgccggacaatgattctgcttattcggaacgctggcggcaaatcaagcggcacagccaatatttaatcggcggcaatctcaggctttggcaaaaacgcttttgggaatatactatccgcgatgaggccgattttgcctggcattttgattatctgcatttcaatccggtcaaacatggctatgtaggacaaatttccgattgggggttttctacgtttcaccgttatgtcaaacagggtatttatccgcataattggggtggcggcaatgcggacttttctattggatacgattgaagtaatgtcggattcgagaatccgacctacggaaaactgaaagagcatcggttgcagaacggcattatgcgcaaagcctgccgcaaccgtccgctgacggaggcgcaaaccaaacgcaaccgatatttgtcgaaaacccgttatagtggattaaatttaaatcaggacaaggcgacgaagccgcagacagtacaaatagtacggaaccgattcacttggtgcttcagcaccttagagaatcgttctctttgagctaaggcgaggcaacgccgtactggtttttgttaatccactatatgtggtcgaacagagcttcggtacgctgcaccgtaaattccgctacgcccgggcagcctatttcggactgattaaagtgagtgcgcaaagccatctgaaggcgatgtgtttgaaccttttgaaagccgccaacaggctaagtgcgcccgctgccgcctaaaaggtgccccggatgcctgattatcaggtgtccgggcaggattaaaggggtatttgggtaaaattaggaggtatctggggcgaaaacagccgaaaacctgtgtttgggtttcggctgtcgggagggaaaggaattttgcaaaggcctcaagatatagtggattaaatttaaatcagtacggcaaggcgaggcaacgctgtactggtttaaatttaatctactatatttccgcctgctgccgcccgaaaagcgtgatgcgctgatggtgctgctgcataatccggacgacggataaccggtgaaaacggaaatgcccgggcggtgttgcctgtgcctgtttggacaagcgttcttgagggcggtagaattgaggtttgcccgaaaagggcagggcgatatgccgcgcttggattttgcgcgcggtttttcgcgttgaaagcaattatgtctgtttgaatatttaatgccgtctgaaacgtccggacgcgcccccgttccctatgagaaaaccgaccgataccctacccgttaatctgcaacgccgccgcctgttgtgtgccgccggtgcgttgttgctcagtcctctggcgcacgccggcgcgcaacgtgaggaaacgcttgccgacgatgtggcttccgtgatgaggagttctgtcggcagcgtcaatccgccgaggctggtgtttgacaatccgaaagagggcgagcgttggttgtctgccatgtcggcacgtttggcaaggttcgtccccgaggaggaggagcggcgcaggctgctggtcaatatccagtacgaaagcagccgggccggtttggatacgcagattgtgttggggctgattgaggtggaaagcgcgttccgccagtatgcaatcagcggtgtcggcgcgcgcggcctgatgcaggttatgccgttttggaaaaactacatcggcaaaccggcgcacaacctgttcgacatccgcaccaacctgcgttacggctgtaccatcctgcgccattaccggaatcttgaaaaaggcaacatcgtccgcgcgcttgcccgctttaacggcagcttgggcagcaataaatatccgaacgccgttttgggcgcgtggcgcaaccgctggcagtggcgttgattttgaacccgcgccgcaaccgaaatacggcgaatcctgtataatccgaaaatctgttcactggaagttcagacggcattgcaactgttgatgccgtctgaaaaaatatgatggcaagagacaaccgcatccaaatgtttccgcacgaatggcgcgccagtacgacgctttccggcgtgtacgcgctgcgtatgctgggtatgttcctcgtgctgcccgtattggcggtgtatgccgcctcgctgcccggcgcggaaggcaacaaaacgctggtcgggctggcaatgggcatttacgggctgacacaggctctgctgcaactgcctttgggcatcgcttccgacaagttcgggcgcaagaaaaccatttatgcgggactggtcgtgtttgcggcgggcagctttcttgccgccgccgccgatacgctgcccatgctggtcgccgcacgcgccatacagggtgcaggggcggtcagtgcggcggttaccgcgctgctggcggatttgacgcgcgacggcgtacgtacccgcgcaatggcgatgatcggtttgagtatcggtttgacgttttcggtcagcctcgtcgttgcccccgtgattgccgacgcggtcggcgttcgcggactgtttatgctgaccggcattctgaccgtcatcagcatcggcgtggtggcgtggatgactcccgatcccgaagtttccaagctgcacgaagatacgcaggcgcagccttcgcgcataggcgaagttttgaaaaaccgtaggctgctgacgcttgatttcggcattttcgccctgcacgccgcacaaatggcattgtttaccgcgctgcctttcgcgatgacccagctcggtttggaaaaaatacagcattggaaagtctatctgccttcgaccattacgggcttggtggtgatggttccgctgattatcgtcggcgagacgcgcaacaagcttaagcaggtttttgttttgggtatcgtctgtattgcggcggcgcagctcggtttgctgtccggtatgcgctcggtaggcttgattaccgcttatttggttgtttactttatcggttttaatgtgttggaagcgagcctgccgtctatggtttccaaaatcgcgccgtccgacctgaagggtacggcgatgggcgtgtacaacacgatgcagtcgctcggactgtttgccggcggcgcggcaggcggtttgctgtttcaaaaatacggcttttccggcgtgtttgccttttgcagtatattgatgctgctgtggctggtaattgccgttttatcgcctgcgcccaagcccgtcaaaaacctcagttaccctgtcggcggcgtgtggcagggcaatcaggaagggttataccgcgccttgtcggagcttgagggtgtggaagacatcggtttcagtttcgacgggcagaccgtctatctcaaagtgttgcagaagggtttcgatcaggctgccgctgaaaaaatcatcacaggagtttaaaaaatgtcattgaacaaagtcatcctcatcggccgcctcggacgcgatcccgaagtgcgctatatgcccaacggcgaggcggtttgtaatttcagcgtcgccaccagcgaaacttggaacgaccgcaacggccaacgtgtagagcgtactgagtggcacaacatcaccatgtaccgcaaactggcggaaattgccgggcaatacctcaaaaaaggcgggctggtttatttggaaggcagaatccaaagccgcaaataccaaggcaaagacggcatcgaacgcaccgcttacgatattgtcgccaacgaaatgaaaatgttgggcgggcgcaatgaaaacagcggcggtgcgccttacgaggaaggttacggtcagagtcaggaggcttaccaacgccccgcgcagcaaagccggcagcccgcctccgacgcgccgtcccatccccaagaagcaccagccgcgccgcgccgccaacccgtgcctgccgccgccccggtcgaggacattgacgacgatatcccgttctgaattttacggccggacatcctcgcggagggaaatcataaaggacggagaaaccttaaaccttacggggcagggtttctcttttttgcatttgggccggcttgttgccgccctttgcgttgggcggaacgttgcgattgcgccgttcgggcgttttgaggcagtgatgcctgccgcacgtccccgctgttttcagacggtatagtggattaacaaaaatcaggacaaggcgacgaagccgcagacagtacaaatagtacggaaccgattcacttggtgcttgagcaccttagagaatcgttctctttgagctaaggcgaggcaacgctgtactggtttttgttaatccactatattttaaaattcaggcggtgttttcaaatagcgcgaagcaatagccgagcttcagccggtttgtttgaaatcaaagggttggaatcaaacgccaaacgcttgaaccatcattgcccgatgcggcaaaccggcatcgtccggcaatacggttgtttaaaaataggaaaatcaggatggaaaaccaaaggccgctcctaggcttcgcgttggcacttttggcggcgatgacgtggggaacgctgccgattgccgtgcggcaggtattgaagtttgtcgatgcgccgacgctggtgtgggtgcgttttaccgtggcggcggcggtattgtttgttttgctggcactgggcgggcggctgccgaagcggcgggatttttcttggtgctcattcaggctgctgctgctcggcgtggcgggcatttcggcaaactttgtgctgattgcccaagggctgcattatatttcgccgaccacgacgcaggttttgtggcagatttcgccgtttacgatgattgttgtcggtgtgttggtgtttaaagaccggatgactgccgctcagaaaatcggcttggttttgctgcttgccggtttgcttatgttttttaacgataaattcggcgagttgtcgggtttgggcgcgtatgcgaagggcgtgttgctgtgtgcggcaggcagtatggcatgggtgtgttatgccgtggcgcaaaagctgctgtcggcgcaattcgggccgcaacagattctgctgttgatttatgcggcaagtgccgccgtgttcctgccgtttgccgaaccggcacacatcggaagtttggacggtacgttggcgtgggtttgttttgcgtattgctgcttgaatacgttaatcggttacggctcgttcggcgaggcgttgaaacattgggaggcttccaaagtcagcgcggtaacaaccttgctccccgtgtttaccgtaatattttctttgctcgggcattatgtgatgcctgatacttttgccgcgccggatatgaacggtttgggttatgcaggcgcactgatcgtggtcgggggtgcggttacggcggcggtgggggacaggctgttcaaacgccgctagtttgcaggcaacggaaaatgccgtccgaacgaggtttcagacggcattttatttgagggaaggattagcgcggatgaaccatatcggcaggaacgaccagttcgtcaaattcttcgcccgtcagcaagcccaactcaacggcggtttcgcgcaacgatttgttgtttttgtaggcggttttggcgactttggcggcgttttcgtaaccgattttacggtttaatgcggtaaccagcatcagggaatggtgcaggaaatagtcgattttttccggcacgggttcgatgccgatggcgcagtgttcgttgaagctgttgcacgcgtcgcccaacaggtggatggattgcaagaggttgtaggcgataacgggcatatagacgttcagctcgaaattgcccgacgcgcccgccataccgatggtaacgtcgttgccgaacacttggcagcacaccatcgtcattgcttcgcattgggtcgggttgactttgcccggcataatggacgaacccggctcgttttcggggattttgatttcgcccaaaccgcaacgcgggccgcttgccagccaacggatgtcgttggcaattttgttcaggcttgccgccagcgttttcaatgcgcccgaagcggcaacggcggcatcgcgtccgcccagggcttcaaatttgttcggcgcgctgacaaacggcaagccggacaattcggcgagtttggcggcggctttttcggcgtattcgggatggctgttcaaacccgtgccgaccgccgtaccgcccaaagcaagttcatacaagtctttaagcgcatcgttcagacggcctaaaccgtgatcaagctgggaaacgtagccggaaaattcctgtcccaaagtcagcggcgtcgcgtcttgcaagtgggtgcggccgattttgacgataggggcgaaagcttgggcttttttgtccaacgtgtcgcgcagggcttttacggcggggatgaggtggcggttgatttcaatcgcggcggcaacgtggatagcggtcgggaatgcgtcgttggtcgattgcgcgtggttcacatggtcgttgggatggacgggctgataagccgccaaacccgtaccggcgatttcgttggcgcggtttgccagcacttcgttcatgttcatattggactgcgtgccggaaccggtctgccacactaccaatgggaactgcccgtcgagcttgccgctcaacacatcatccgccgcctgcgtaatcaaatccgcctgttcaggcttaatcctaccgagggaaacattggtggcagcggcggcttttttcaccaatgccaaagcataaatcaacggctgcggcagggtttcgccaccgattttgaaattgttgcggctgcgctgggtctgcgcgccccaataggcttcggatgggacttcgacattgcccatcgtgtcgtgttcggtacgggtgctcatgcgtttctccttttgaaatgtgaataagagtgattcgcaaatattataatggagattggtgggatgagaaagcatcatggccgcgagaatataaaaatgccgtctgaagccctaattggtttcagacggcatttgtttaggtgtggggttacagcacggatttcaccgtatcaaccacattgtccacggtaaagccgaatgctttgaagagtaaatcggcaggggcggattcgccgaagcggttgatgccgacgactgcgccgttcagtccgacatatttgtaccagccgtcggcgtgtccggcttctacggcgatgcgcggcaggccttcgggcaggacggcggcttgataggcggcgtcttggcggtcgaatacgttggtggacggcatggaaacgacgcgcacggcgatgttttgcgcggcgagggctttttgcgcttccaaagccagctcgacttctgagccggtggcaatgatgacggcttgggcgttgccttgggcttcgctgatgacgtagccgccgcgtttgatgtcgttcagttgttgctcgctgcgcgcttggaatttcaggttttgacggctgaaaatcaggcaggacgggtgatcggcggctttgacggcttctgcccaagccaccaaggattcggcggtgtcgcacggccgccatacgtccatattcggaatcaggcgcagggtggcggtttgctcaatcggttgatgggtcgggccgtcttcgcccaaaccgatggaatcgtgggtaaacacaaatacagggttgattttcatcaacgcagccatacgcagggcattgcgctcgtattcgctgaacatcaggaaagtcgcgccgaagggttttacgccgccgtgcaataccaaaccgttcataatcgcacccatgccgaactcgcgcacgccgtagtggatgtagttgccgcctttgtcgcgggtaacggagacgctgtttgaccagtcggtcagattggacggggtcaggtcggcagaaccgcctaccaattcaggcaactcttttgccaagatttcgatgctgttttggctggctttgcgggtggcgatggtttcggctttggcgcacacttctttcaatgcggcttgaacgtattcatcgaaattgtccggcagctttttatccatacggcgcacaaattctgcggcttcggcaggatatttggcttgatattgcgcgaacagttcgttccagtcggcttccagtttcgcgccttgttctttggcattccacgcatcgtaaatttcttgcgggatttcaaaggcggggtaagtccagcccaaatgtttgcgcgtggcttcgatttcgtccgcgcccaaaggtgcgccgtgggttttgtggctgccttctttgttggcactgcctttgccgattaaggttttgcagcagatgatggacggtttgccggtttcggcacgtgcggcttcgatggcggcttgaatggcggcggtgtcatgaccgtttacattgggaacgacgtgccagccgtagctttcaaagcgttgcgggatgttttcggtaaaccagccgtccactttaccatcaatggaaatattgttgtcatcatataaaacaatcagtttgcccaagcccaaggtgccggcgagcgaacaggcttcgtgcgatacgccttccatcagacagccgtcgcccataaagacgtaggtgtaatgatcgacgatgttcaaaccgtctttattaaattcggcggcaaggattttttctgccaatgccatacccaccgcgttggcaatcccttgccccaacgggccggtcgtggtttccacgccgtcggtgtagccgtattcgggatggccgggggttttgctgtgcagttggcggaagtttttcaagtcttcaatgcttaggttgtagccggtcaggtgcagcaggctgtacaacagcatagacgcgtggccgttggagaggacgaagcggtcgcggttgtagaatttggggttggcggggttgtgattgaggaatttcgtccacaatgtttccgccatttccgccatacccataggcgcgccggggtggccggaattggctttttgaacggcatcggccgagaggaagcggattgcgtttgccagttgagacattttgtattttccttgctggtgtttcagataagtggataatcggaaagcgttgattatcgcccgattcgcttatgctttcaagaaaagggcggacgcgtgggaaggcggcggcaggggacaggcggggaaggattttcgatttgcgggcgaagcctgccattattccttttgaaataaaaagttatagattgtgtgccggattgtcgatagcgtttgtttatgagcttgcgccgtcggttctgccgatatgggggtgtcggtttttttagtctttttttttaaccgtattcggattttgttcgggcggtaaggtaaaatccaggcgttttgatgcggatgggaaatgtatccgccccatacatccggacggcgcataaagttgtacaatagcggaaatatattttgggaaaaacggattttctcaaaacttgaaacacaacgccttaaaaaacaagaaaaatgacgtctgaaaagcaaacggcggcggtaacgggcaaaccatcaatcaaaaatctaaggaatgcagaatgaccacggaaaaccaagccggcagtccggcatccggaatcggcacgtccgaacaaacaaaagccgcgccgaaagcaaaaaaaacattcgatccgcgagccagcgtgattcaaatccatcccgaaggcgaacgcatccatcccaaaaaggcggaaggacggttcgccaaactgcgtatcgccgccgtattggcgacgcagtttgtgttttacgtcattccgtggttcaactggagcggcaggcaggccgtcgttttcaatatccccgaacggcatttcttcattttcggattgtcgttgggggtgggcgatttgatttaccttgccttgctgctgatgatttgcgccttcgggctgttttggtggacgacgattgcagggcgactgtggtgcggctattcctgcccgcaaacggtttacaccgaaattatgctgtggattgacaacctggtcgaaggcgatagaaacaaacggctgaaactggaaaaatcgccgtggaatttcactaaaatccgcatcaaagccaccaaatacctgctgattttccttgtctgcgcgtggacgggcatcacgtttgcaggctggtttgtccctatccgccagttcgttcccgatttattcactggagcagcaggtggcggcgcgatgtttgccgcagcgttttatggctttatgaccttcttcttcgcccacattatgcgtgaaaaagtatgcctgcatatgtgtccgtatgcacgtttccaaagcgcgatgttcgacaaggacacgctgattgtttcttatgacgcggaacgcggcgaaccgcgcggcgcgcgcaagaaaacggtcaataaggaagaggcgggtttgggcgactgcatcaactgtgcgatgtgcgtccaagtctgccccgtcggcatcgacatccgcaacggtctgcaataccaatgtatcggctgcgccgcctgtatcgacgcgtgcgatgagattatggacaaaatgggctatccgcgcggattaatccgttatacgaccgaaagcgcgctggaacacgaatattctgaaaaagacattaaaaaacggctgctcagaccgcgcgtggcaggttacggcgcggtgttggcgttagttatcattgccttcctggccggtttgtccacgcgcaaaatggtcgaggtcgatattttgaaagaccgtggcgtactggtgcgcgaaaacgccaaaggctggctggaaaacgcatacagcctgcgtatcatcaacaaaagtgaaaaagaacagctgattaccgcaagtgtcaaaggctttgacgaaatcgccctgaccgggctgcccgaaggcggtatcaaggttgccccgcgcgaaacggtaacccttcccgtccaagtgtccaccattccggaatacgcggacaaaggcagccaccctatcgaatttaccttccaataccgcgaaagcggcgcgcccgacggcaagccggtcgtcttggaagaagatgcaacctttatcggagaataaccgtgtctcaaaacactccaatcaaaccttggtacaaacacgtctggccgtggatcttgatggcggggccgatttttgtcgtcatcgccagcgtcgctatgttttttgtcgcgcagcagcacgcgacagatttggttacggacgattattataaagacggcaaacatatcgacatccagcttcatcgggatgaagaagccgtcagacggcatatcggggtgcaggttctcatttcccccgatatgaatgcggcaaaagtgtttgtcggcggcgagtttgacggcaaacagcctttgaacctgctgctgatgcacccgacccgcaaggcggacgatcaaaccgtcgccctcaagcccgtcggcagcgcgcagaacggcagggcggaatatgaggcggtgttcaaaaccctttcgccgaccaaccactggtatgtgcgcgtggaggacgcggcaggcgtgtggcgcgtcgagaacaaatggattaccagccaaggcaatgcggtcgatttgaccccgatggacaagcttttcaataatactgaaagcaaataaaaaagccgtgttttcattgcattgctttgccagatgtaatgccgtgcaggcattatttgatcattcggcgcgatggtttgatttgtcggacgaaaataaatgtatctcatcccgtttattttttaacactattccggaacgcagcctgaaaaacgccgtctgaaagcccttcagacggcattttgtttgcaaatcaaatcctacctgatgtcagcgtccgagcgttgcaacaggttcgctccccgtcagcagatattgtatcgtctcgcggacggtgcggatggcattgccgaagggcagcggtctttacctctgaagaacaggcctttatctacttctccacggaatgcggcggcaagctggatatcaatacagaactgtcctgctttggaaagcccgtcgcgcagaccgcaactggttaggcagtttaaaccttgggtacagcggcgcgggtcggctttggcgtttgtctgaagtttgctttcacgcttgatgtagctgtctaggaatttggtgcggacaccgcgcgccggcaaaccggcaacagacataaattcgactactttttcagtttccgcaccggcgagcgtttttttgaagttaaggtgtgcatctccttcttcggtaacggcaaaagccgtaccgatttgaacggcggatgctccccagttctttagggcggttttgactttttcaaaatttgccatgcctcccgcaagaataagcgggattttttcgctttccagccctaaacttttgaaaacttcaaacgtttcctcaatcacgcgtttgaagtcgaacttggcatcgtttacgccttcaacggttgatgcacccaaatgtccggccgcgtgggcaggatgttcgactacaatcgcatcgggcaatatgccttttttcatccaacgtttcaagacgatattaataccgcgcgattcggacagaatcggcagcagcgcgacatctttatgatagccctcggtcatttccggcaggtctaaaggcaggccggcacccattacaaccgcatccgcccctgattcgcaagcctggcggacatatgcggcgtggtctttgaccgccttcatcacgttgaccgcaatcagtccttttccctctgaagcgcttttggctttttggatttccctgtctaatgcggtacagttcaaagatgtatatttctcttcactcggattgatttgtgattcggcgagtaggtcttcgtgaaggtggcgcaaatccacactggcaatcgttccgataccgttttcacgcgccaccgcgctggataaacccgatgcggaaacaccgacccccataccgccttgcacgatgggggtaagggattttccacgaataaccaaagggtcaaaaatattctgcatcagtttctccgagtgtacgaatcagtcaggctcatgaaaaatggttctaactgttttagaactattgctcaaatttggtattatactctaaatatcgcggcggtaaacaagaaagcagccggagcttcgggcattctgttacgcctgtttcaatcgggagagaaaatattatagtgaattaacaaaaatcaggacaaggcgacgaagccgcagacagtacaaatagtacggcaaggcgaggcaacgccgtactggtttaaagttaatccactataaatttgatgatggcataaaaaagccctagtcagttgctgtcaaaggggattgttaagaaaagtaatgccacgttgatggggtgcaatatatcaggcgtttcaatcgggtaaaatgttggacggacaccgcatccggttatgggatatcggtttgcacggcaaaggtttgaatatgattcgattacgtctgagattctgatgaagggggtaggtaaagatatggtaacgagttgctgagacaataaaaaatccccgagcgataatctcggggatttagaatttggcacgcccacggggaatcgaaccccggttaccgccgtgaaagggcgatgtcctaaccgctagacgatgggcgcatattgtattttcttactggcgcacccggagcgattcgaacgcccgaccctctggttcgtagccagatactctatccaactgagctacgggtgcgctgcaagaaagattcgaattttagggtaatcatcggattctgtcaattgttttgttggatgaaatgccttaaaagtgtaaaatattggtttgttgtttgaatttaaagagaataaaatgattgttgcttctcgctggcccttgctggaaaaggtatttttacggtttggaatgcctgttgccgtggttgatttggaatcgacgggcggcaatctgtatgaagacagggtaaccgaagtggctttggtcaagtttgagcagggaagggtggtgaggcatgagtggttggttaatcctcaaaaaccgattccgcagtttgtggcggggctgacggggatttcagacggcatggttgccgatgcgcctgtttttgcagagattgccggcgagttgttttcggtattgaagggttgtgtgctggttgcacataacagccgtttcgactatacgtttttaaagcatgagtttcatcgtgcgggtatcggattttcatcgcctgctttgtgcagtgtgcagctgtcccggtgtctgtatccgcaattttacaagcacagcctggacagtatcatcgaaaggttggggattgttgtggaagacaggcatcgtgcgatggcggatgtatcggcattgtgtgattatttggaatacagtctgtcggaacacggggttgaggcatggatcaggcagtgtttccgtttgatgaatccgaaaccgctgcctgccgcgctgcccgaacggttgagggaacagttgtacggtttgcctgacggtatgggggtgctggcttgtttcgacggcggagggaaagtaaattatatcggtacgtttgaacgggtatatagcgagatttcggctttattggactccggaaaagccccgtttgattggtgcaatacggaggaagtccgtttttttcccgcattgggcagcctgcatgcatataagattaaagcggaattggtcgggcgttatcattcggattgttatgtgtctgccaaaaatctgcttaaaacatttacgaccgtcaggtttgaaaaaggttcagacggcatgttgaatgcgaaaacagcggctttgaaaaacggtgtgacggataatccgcctaccggattatttgccaataaaaaggcagcgagacgggctttgtcgtcgtgggcggaaacatacggattgtgtcctgccgcagccggtatccttccggacggttatgcagaggatgagccttgtcccgtatatgtttcaggccgatgcgataaggcgtgcggccgttctgacgaacaggttttggcgtttgcacacaagttgcctgttttggattggggaaaaatgcatgaggtggaaattaccgaaaccgatcctttgacgggggaaaaagtcgttctgcacggaatgggcggcgcattggaaatggatgacgggctttggtatttcgataaagatttaccggatgcgtttaaggcgaagtttaaaacggacaggaaaaatattaaggaaatcggttaaatcgatatcggttggtgaaagccggcaagtatgtaaacagccgtcaccgtgttgattgcctaatcggtttgtgccggtgtgttgccgtttgcaggtaatgtatccgaagatgccgtctgaattttttcagacggcatttttgccgacgcggttttcgtgccgtgtcggtttgcccgtccatccgaaggcatcggacaagcagggtggtttttagaagccgttttccatcatgatttgaccgggaatgcggttgcggtgcatggcgtaacccatgtcgagcagcgtttggaaagtgtctttgaccatttccgggttgccgcaaatcataaaccgtgtggattccggggtgaacttggtatgcagcgcctgttcgatgctgttgttttttaagagttccggaatgcgttttccgcttaagcccgaggggttggcggcacgggtggtaacagggacgaaacggaaagagtgtccgtattcgcctaccaggggatgttcagtcaatgcggcgagtcggtcgttgaaaatcaattcttcgggaaaagatacggaatgtatcaggttgacggtatcgaaacgttgacggatttcgggttgttcgagaatggaaaggaagggggcgatgcccgagccggtgcagagcatcaccaaatccttgccgtcggggaagcgttcgggcaggaggaagccggtggcatttttatcgagcaggatggtgttgccctgttgcattttggcgaaacgggccgacatggggccgtcttggatgagtacggcaaaatattcgagcgtgtcggcatattctgcggaaacaatggaataggcacgccaaatgaaaccttccccttcgtagaaaccgagtcgggagaactgtccggctttaaagcggtaggattcgggacggctgatggcgaaagtgatgagtttcggcgtgtggtgtttgacccacaaaatcttttcttcggtgaattttgcttcgggcgaggctgccatgttgttgtccttgagtgtgtttgtcgggattatagccaatttgggtgtttttttctgcattggcggtctgtatttaaattcggatatttttcaatacaatgttatcgttttttgaaataaacggtaaggagtagtttgttttttgtcaaaatgggaatacaatcctatctataaatttaattgagaattactttttttcaattaatataaaaaatcaaaacagttgtgagagcctttggacgatttgcacacttgcatattacagaggtctctatgaatcaaaatcatttttcacttaaaattctgaccgttatgctgttatcggcttacggtggttcttttgcagacggtgttgtgcctgtttcagacggcaataccgtcagtctggatacggtcaatgtacgcggctctcatgctttgttgggcaagaccgaaaagacccgttcttatacgatagatcggatgtccaccgccacaggtatgaggattgcgggcaaggatacgccgcagtcggtcagcgtcatcacgcgcagccgccttgacgataaggcggtgcatacgcttgaagaggcaatgaaaaacacgacgggtgtcaacgttgtgcgcgattcaggcttgcagacgcggtttttgtcacgcggtttctatattgatcagattggtgaagacggtatgaccgtcaatgttgcaggccgttcgggatatacggcgaaaatcgacgtgtctccgagtaccgatttggcggtttatgaccatattgaagttgtacggggtgcaacggggttgacccaatccaattcagagccgggaggaaccgtcaatttgatccgtaagtgacctaccgcttctttcaaacataccggagagctgaccgccgaccatcgcggcagccggcgtgcagtgttggatgtttcaggcagcctgaataaggcgaataccttacgcggaaggttggtgggtgcggaagagtataaaaaatcgtttaaagaccgagtttggggcaggaaacatatggtttacggcattgccgaagccgatgcgggcgacagcagtgtgcttactttgggcggcatgtatcagaagagtagggaggttcctgatttttcgggcattattttgccctgtgaaaatcagaaaactgccccgttcagttcaacgcctgcctgcaaccggcctttgcaactgccgcgcaacacttatttgggggaggattggtcgcggttaagtgccgacaaatacaaccttttctcaggattcaaacatgtgtttgacaacggttggcagctcaatgccgaagtgtcttataccaagaatgaatccgatgcgaaggtggggcagttttttctgaaaaacgaatatgcggcgggtttgtcgggtgaggatgcggtaggctttttgactgaaaaaaacgaagtcatcccgttcgagccgaaagataaggcattggagaaactgaaagcatatcgtgatgaaaccgccaaggaataccgggagcgcaaagacgattttgttaaaaaccgtttcgataatactgctttcgaacagtatcgcagccgccgtgccgcagaacgcaaagccggttttgacaagtgtatgagtgaccctttcgcgctggactttatctgtcaaggttcttggggggatccgggcgttgatgccgacaaggcggaatttgtcgataaagcccttgcgaaggagggcatctttaataatgcggcacaacgttttccaaacagcctgtatgactcttcctttaatcggaaggctaccgccaaccgacgatacagttatatgccgttgcggcataccaaagacgaccgccaatggggaattaaacttgacctgaccggcacatatgggctgttcgggcgggagcatgatttctttgtcggctatgcctacggtgatgaaaagatacgttcggaatatctagaaatctacgaacgccgctacagagtacgtccgaatacgggggcaacgcacggcgtgtatgcgggaagttgtcaggaggagccggacggcgatttgtcgtctcctttggtcagggggcataaagaacccgattggcaggcgtacgatgaaaaaggcaaccgtaccgtttatgccgaagaatgcaggaacgccaagaaaataaaaaccgagcccaagctcgatgccgaaggcaagcaggtgtattactatgacgaatacagcggcagccggacaccggtatatgtcgatgtatatgagctggacgaaaaaggcaacaagattcaggagaccaatcccgacggcacgcctgcctttaccggtttttccggtacggtgccggtttggaaaaccgtcaaagtggcagacgaccatgttcctgcgctgtataactacgccaaatacctcaacaccaacaaaacccattcgctgactgccagcacgcgtttcaacgtaaccggccgactgcaccttttgggcgggctgcactacacgcgctatgagacttcgcaaaccaaagatatgcctgtccgctatgggcagccggcaagcgattttcagacggcatcgagcattagggcggatcaggaccattacacggccaagatgcaaggtcataaattgacgccctatgcaggcattacctatgacttgacaccgcaacagagtatttacggaagttataccaaaatcttcaaacagcaggataatgtcgatgtcagtgccaaaaccgttttaccgcctttggtcggcacaaactatgaggtaggctggaaaggcgcgttcttgcaaggacggctgaatgcttcgttcgcattgttttacctcgaacagaaaaaccgcacggtcgtcgatttcggctatgttcccggagcaggcggcaagcaggggtcgttccaaaccgttgccaaaccgataggcaaagtggtcagcaggggtgcggaattcgagttgtcgggtgagttgaacgaagattggaaagtctttgcgggttacacctacaacaagagccgctacaaaaacgccgccgaagtcaacgccgaacgccttgccaaaaattccagtgcagacccgtacaacttcagcaatttcacacccgtgcacatattccgtttcggaacgagcttccatataccgaatacggggctgaccgtcggcggcggcgtgtccgcacaaagcggcacaagcagtctgtataacatcaggcagggcggctacgggctgatagacggtttcgtccgttacgaattgggcaaacacgccaaattgagcctcatcggtacgaacttaaacggacgcacttattttgagaacaactacaaccgtacgcgcggcgcaaacaacttctacggagagccgcgcactgtcagcatgaaactggattggcagttttaattgaaaaccgtagttttgcggatgccgtctgaaacagggtatgtttcagacggcatttttatggaggcaggtctatcggggcgtatatttggaatttgcccgatgccggcagtagaatatcccttttatcctcagaagagccgatgtcttcacgcaaaattatccacatcgacatggacgcattctacgcatcggtagagctgcgcgaacagccgcatttgaaagggcggccggtggtcgtcgcgtgggagggcgcgcgttcggtgatttgcgccgcatcgtatgaggcacggcagttcgggctgcattccgcgatgtcggtggcaacggcgaaaaggctgtgtccgcaagcggtgtatgtgccgccgcatttcgatttgtaccgtcaggtttccgcgcagattcacgccgtattcaggcgttataccgatttaatcgaacccttgtcgctggacgaagcctatcttgacgttacccgtaatttcaaaaacatcccttacgccggcgacgttgccaaagaaatccgtgccgccatttttgcggaaacaggtttgactgcatccgcaggcatcgcgccgaacaaatttctggcgaaaatcgcgtcggactggcgcaagccgaacgggcagtttgtgttgccgccgcacaaagtcatggcatttttggaaaccctgcctttgggcaaaatccccggcgtgggcaaggtaacgctgaaaaaaatgcagtcgctgggtatgcggacggcgggcgacttgcgccgtttcgagcgcggcgaactcttaaaccatttcggacgctacggataccgcctctatgatttggtgcgcggtacggacgaacgccccgtcaaagccgaacgcgaacgcctccaaatctccacagaaattaccctgcccgaagacctgccgctcgagcaggctgccggacacctcccccatcttgccgaagacttgtggcggcaaatcacgcgcaaaaacgtcgaagcccaaagcgtaacgctcaagctgaagacctacgatttccgcatcatcacgcgcacactgacttattcctccgtattgcccgactgcgcactctgctgcaggctgcgcaaatgttgatggcgcgcgttcgccgcagacggaagacgcgttccgccttatcggtatcggcgtggggcatcttgtgccgaaaaaccagcagcaggatttgtgggcgtaaaccgctttacgcgcgccgtccaaaaaatatgccgtctgaagccttcagacggcattgcggctccggtttaatccgccgcgccgcttttttttaggttgtcgagccttccgattatatcggcaaggttgcgtctgccttcttctttgctgacaatcggttcgccgcctttgcgccccaggattttcaaatcttcctgcggcatttcgtctatgaatcggctgggttcggggaactgccatgtgccttgttttttgcgtttgacgcagtgggtcagtgtgagttggcgtttggcgcgggtgatgccgacgtacatcaggcggcgttcttcttcgacgttgccctcttcgatactgtcgttgtgcggcaaaacgccttcttcgcaaccgacaaggaaaacatacggatactccaaacctttggcggcgtgtagcgtggatagcgagacggcatcggtttcttcttcgtcttttccttccaaaagcgtcatcaaggcgacggtttgggcgagttcgatgatgtttttgccgtcttccccgccttttcgcgcaaaccatgataccaaatcgccgacgttgcgccatttgatttcgccggctttgccttcttcgttttgcatcaaatggttttcatagtcgatttcttcgagcaggctgttgatgaactcgcccgcttcgctggtttcggctttggcgaggtagctgacgaacatatccataaaggtttgcaggtgttggcggttggtattgttcagcgtggcaagggcttcttcgttttgcgcggcttcatacaggctgcattcgtgttcgtgcgcgtaagtgttgagcttgcccagcgtgacatcgccgatgccgcgtttgggcgtggtaacggcacgcagaaaggcgggatcgtcgttggggttggcaagcagccgcacataagacaacacgtctttgatttcggctttgtcgaaaaagctttgtccgccggagagctggtaggggatgcgcgcgccgcgcaatgcttcctcgaaaatcctcgcctgatgctttccccggtataacacggcgaaatcggcatattgggttttgtcgccgccgatgagtttttgtttgacgatttggctgacgacccagtcggcttcgtgttgctcgttttggcaggcaacgactttgaccggctcgccttcgcccaattgcgaccaaagttttttggtaaacagcttggggttgttttcgatgactttgttggcgattttgagaatccgcgcggtggagcggtagttttgctccagtttgatgaccttcatctgcggatagttttcctgcattttacgcaggttttccatgttcgcaccgcgccatgcgtagatggactggtcgtcgtcgccgacggcggtaaacataccttccgcgccggtcagcagcttcatcaacgtaaattggcaggtattcgtatcttggcattcgtcaaccaacagataacgcagccgccgctgccatttgttgcgcacttcgctgttttgctgcaacagcacggcaggcaggcggattaagtcgtcgaagtccactgcctgatagctttgtaaggtttcctgatagctcgcatacacgcgtgcggtttgttgttcccaaatgttcgatgccgtctgaacgacatcttcaggcgtttttaaatcgtttttccacaaggaaatctggtgctgcgccttgaatacggcttctttgcccgtaccgcctaagagttcgccgatgattttcgcgctgtcggtagaatcgagaatggagaagttttttttgtaaccaatatggttcgcctcttcgcgcagaatcttcatgcccaaagagtggaacgtgcaaatcgtcagcccgcgcgtttgcggtttgggcagcattttggcaacgcgctcctgcatttccgcagcggctttgttggtaaaggtaattgcggcaacggtatgcggcaggtagccgacattgacaatcaaatgcttaattttttgagtaatcacgccggttttgccgctgcctgcaccggcaaggacgagcagtgggccgccgaggtagcggacggcttcgagctgttggggattgagtttcatcatgttttgatgctgtctgaaatcagtctgcgccgttttcgaggcagtcgagtgtcgcacggagggcggatacgccgatttgccccggcgcggagttttgcgttcccgaaccgaacgtgatgcttgagccgaacacctgtccggcaagccggctgaccgcccccgtctgccccatcgacatcgtaacaatcggtttggcggcaagctctttcgctttgagcgtggcggaaagcaaagtcagcacatcttccgcgctttgcggcatcaccgcaattttgcagatgtccgcgccgcagtcctccatctgtttcagacggcatacgatttcttcttgcggcggcgtgcggtgaaactcatgattgcagagcagggcggcgatgccgtttttttgagcatttgccacggcgcaccggacggcggtttcgccggaaaacagctcgatgtcgatgatgtcgggcaggcggctttcgatcagcgcgtcgagcagttcaaaataataatcgtccgaacacgggaacgagccgccttcgccatgccgtctgaacgtaaacagcagcggcttgtcgggcagcgcgtcgcggacggtctgcgtgtggtgcaatatttcgccgatactgcccgcgcattccaaaaagtcggcgcggaactccgcaatatcgaagggcatatttttgatttgctcaagtacggcggaaagttcggcggcatcgcgggcgacaagcggcacggcgattttggtgcgtccgcttccgataacggtatttttgacaacaaggcaggaacacataaaacaggcacacacagaaaaaacagccgccattataacaaagccggccgccttttagacggcatccagattccattccggcacaagccgccgcgtcctggcgcatatcggcaagcaaggaaatatgcgataatggcaacctcgtgaagcagcattaccgatagcccgcacatcgggaaaacgatacacatcccgcgccgcagcccgtgttgcgccgcatcccacataccgcatttgttccggagtaaccccaatgtcagacgacaaaagcaaagcacttgccgccgcactggcgcaaatcgaaaaaagtttcggcaaaggcgccatcatgaaaatggacggcagccagcaggaagaaaacctcgaagtcatttccaccggatcgctcggattagacctcgccctcggagtcggcggtctgccgcgcgggcgcatcgtcgaaatcttcggccccgaatcctccggcaaaaccaccctctgcctcgaagccgtcgcccaatgccagaaaaacggcggcgtgtgcgcctttgtcgatgccgaacacgcctttgatcccgtttacgcccgcaaactcggcgtaaaagtcgaagagctttacctgtcccagcccgataccggcgaacaggctttggaaatctgcgacacactcgtccgttcgggcggcatagatatggtagtcgtcgattccgtagccgcactcgtccccaaagccgaaatcgaaggcgatatgggggacagccatgtcggactgcaggcgcgcctgatgagccaggctttgcgcaaactgaccggacacatcaaaaaaaccaacacgctggttgtgttcatcaaccaaatccggatgaagatcggcgtaatgttcggcagccccgaaaccaccaccggcggcaacgcgctgaaattctattcttccgtccgcctcgacatccgccgcaccggatccatcaaaaaaggcgaagaggtattgggcaacgaaacccgcgtcaaagtcatcaaaaacaaagtcgcccccccgttccgtcaggcagagtttgacatcctctacggagaaggcatcagttgggaaggcgaattgatcgacatcggcgtgaaaaacgacatcatcaacaaatccggcgcgtggtacagctacaacggcgcgaaaatcggtcagggcaaagacaacgtccgcgtctggctgaaggaaaatcccgaagtcgccaatgaaatcgacgcaaaaatccgcgccctcaacggcgtagaaatgcacatcaccgaagggacgcaggacgaaaccgacggcgaacgccccgaagaataaaacctgaaatcccgataaacggtacttctgctgcgaagtaccgtttttttgagccgcctccgaacggcttgatttgagttttggtatagtggattaacaaaaatcaggacaaggcgacgaagccgcagacagtacaaatagtacggaaccgattcacttggtgcttgagtaccttagagaatcgttctctttgagctaaggcgaggcaacgccgtactggtttttgttaatccactatatttttgcccgacggggtgaaaaatacagttgctacagcccgacctacgcccgctttgcctctatcctgcgcccttttatgtgcaacactttgcacttgctgaacaaaattcaaacgaccctttatatcaaatgcaaaaaatatgccgtcattcccgcgaacgcgggaatccagacccctcggcatggaaatttatcgagtaaaacggtttctcagattctacgttctagattcccgcgttcgcgggaatgacggcggcggggggttctgttttttccgatagattcccgtggtttttcggttactggattcccgcttttgcgggaatgacggggtgtaagtttctgctcccacggggctggattcccgttttcacgggaatgacgaaatttcagacggcatcggaatttttgtgttttggtgggcttcagcctgccgcatcccatcgattctgccgtttttaccgtttccgccgaatcctgcaaactgatgccgtcattcccgcgaaggcgggaatccagacctgtcggcacggaaatttatcgagtaaaacggtttctcagattctacgttctagattcccgcgttcgcgggaatgacggtcgggggtttccgttttttccgatagattcccgtggtttttcggttactagattcccgcgttcgcgggaatgacggcggcggggggttctgttttttccgatagattcctgtggtttttcggttactggattcccgcgttcgcgggaatgacggggtgtaagtttctgctcccacggggctggattcccgttttcatgggaatgacgaaatttcagacggcatttaagcggtacggatgtgtaaataatggtagggtgggcttcagcctgccgattcccgctattcttgccgtttttgcgttcttatcattctcactgtttttaccgttcacgccgaatcctgcaaattgatgccgtcattcccgcgaaggcgggaatccagacccgtcggcacggaaatttatcgagtaaaacggtttctcagattctacgttctagattcccgcgttcgcgggaatgacggtcggggggttctgttttttccgatagattcctgtggtttttcggttactggattcccgcgttcgcgggaatgacggtcgagggtttctgtttttccgatagattcctgtggtttttcggttactggattcccgcgttcgcgggaatgacggggtgtaagtttctgctccgacggggttggattcccgctttcacgggaatgacgaagtttcagacggcatttaagcggtacggatgtgtaaataatggtagggtgggcttcagcctgccgattcccgctattcttgccgtttttgcgttcttatcattctcactgtttttaccgttcacgccgaatcctgcaaactgatgccgtcattcccgcgaaggcgggaatccagacccctcggcacggaaatttatcgagtaaaacggtttcttagattctacgttctagattcccgcctgcgtgggaatgacggtcggggatcagcggaagaagtcgcccactccggggggtagaccttgcgtgaatgcgcccattgttttgtttgcggtttcttcggctttgcctcgggcggatttgagggcggcgaggatgaggtcttcaagcatttctttgtcgtcggcggcttcttgaatcaaatcggggctgatgtcgattttgcgtacttcgtgcgcgcaggtcattgtgattttgaccaggccgttgcctgcttcgccttcgatttcggtttcggcgagtttggcttgcgcttttttcatattttcctgcatttgctgcgcctgtttcatcaggccgcctaatccggcttttccgaacatactgaatactcctgtctgttttgattgaataagggaaacggcaatgccgtccgaagggttcgggcggcattatatctgtttatggccggtttgccgccaattccagtgattcgggctgccattgcgcgccgaatgcttggaggattttttgtgcggcggggtcggcttcgagcaatgcttgtgctttttgcctgtcttcggcttggacgcgcttgtcctgcatcgcgggggtttcccggccggcttcgtcacgccagtcttgggtttgcagggtgagttgcagcccgtaggcttgggcaagggtgtcgcggattttgtcgaggcgttttttgtcggcggtggcgcgtgcttcggcggtcattgccaaaaccatcagaccggtgtcgggatggtattccgtccacgcggagtgttgcgccggcatttgcgccgcgccgagtttgcgggcgaagtgccggacgatggctgcccagttttcggtggaaaattcgggcggcggggcgtatggcgtgtggtcttcgttgttgctgctttcgtcggcgttgttttcttcttccgcatcggcaggggcggcgtgttcccaatcgggcggtgggatttctgcgccgtcttctacgaggtagtcatcattcggaaagctgtaaccgttgaaaggttttgcaggagcttcgtgtgcaaatgcttctgtttcaagggcttcattattcggtgttgcctgaatggggttttcagacggcacttcggacaagggggcatcggtttcgttgtcggctgcttcgttcttggaaacttggtttttgggcggcgttccggcttcggatgccgtctgaatgctttttgccgatgcttgcgccgtgccggctgcggtttcgtccggcgcgtcttcccaaggcggaatatcgttgttttcttgattggtaacgggttcggcagttttgccttcagacggcattgctgctgcggatgccgtctgaacgggtgtttgggcggtttccgcttcagggcgcggttggggcttttttgcggcggtttccttttcggcggtttgtgccgatggggattttagttcggtattttcaatcacggcatttgcatcacacgatgctgccgccaagggcgcaaacgccagcatacgcagcagggtcatcataaagccggcgtattcgtcgggggcgaggctgaggtcgcgtttgccgtggacggcgatttggtagtaaagctggatttgttcgccgcttatggtttgggcgaggcggtgcaaaatatcggaatcggggtcgtcgtgcgccaaggcattcggcactgcctgtatcagggcgaggtgttgcagcagtatggcaagttcgcccaaggcgttgtcaaagccgacggcacacgccgccatttcctgcgctttggcggtcagggctgcgccgtcttggttgatgatgcctgtcagcagttcgtaaaggtattgtttgtcaaccgcgccgatcatttggcggacatcgttttcggcaactttgcccgaacctagggcgatggcttggtcgagcaggctcaaggcatcgcgcatcgatccggcggcggcacgtcccaaaagttgcagggcggcgggttcgtaggcgattttttcgctgtcgaggacgtgggcgaggtggtcggcaacctgttgcgcggtcatattgcgtaagacgaattgcaggcagcggctcaagacggtaacgggaactttgtgcggatcggtggtggcgaggatgaatttgacgtgttcgggcggctcttccagcgttttgagcatagcgttgaacgcgcttttggaaagcatatgcacttcgtcgatgatatagactttgtattttccggcggtcggtgcatattgggcgttttccaagacttcgcggatgttgtcgatgcctgtgttggaggcggcgtcgatttccagcaggtcgacgtagcgtccggcatcgatctgcgtacagctttcacatacgccgcaaggttcgccgtgttgcgcgttttcgcagttgaggcttttggcaaggatgcgggcgatggtggttttacctacgccgcgcgtgccggtcagcaggtaggcgtggtgcagcctgccttcgtccagggcgttttgcagggctttgacgacgtgttcctgaccgactaagtcggcaaaggttttgggccgccattttcgggcgagaacttgataggccatgtttttctcttggtttcggtcgtgatgtttctgtcggtgcgtcggaatgccgtctgaacggcggtctcgggcggcgtattctagcactttcggcttactgtccgcgcaagaacagtgcgtccaattctttcaaagtcagtttgacccaagtcggcctgccgtggttgcactggttgctgcgcggcgtattttccatatcgcgcagaagggcgttcatttcgggcagggtgagccggcggccggcgcggatcgagccgtggcaggacatggtggcgaggatgcggttttcgtgttcctcgatggtttggctgctgccgacttgggcgagttcgtttaatacgtctttggcgagcgagacgacatcggctttgccgagcatggcgggaactgcacggacggcgagggtgttgccgcccatatcggataattccagcccgaagcctgccagcgtttcggcataatcggcaagggcggcgcattcttcgtgggacgcggcaaaggttacgggaataagcaggcgttggctttgcaggttgccgttttcctgacgttggcgtttcattttttcgtagttgacgcgttcggcggcggcgtgcatatcgatgagcaacaggctgtcttcggcttgggcaagaatgtagatgccaagtaattgggcaatggcaaaaccgagcggcggcagttcggattgggacgggatgccgtctgaaagcggcgtatctgtttggggagcaggcgtttcagacggcatattgccgaaacgtgcctgctcgaatcggcttaactcaaggtcgatgtcgtcggtttttttgtaaagttcggcgtaagtattcattgccgcgcggctttcgcgcagggacaggctgcgttgttgcggcgcatatgcggactgatagggcatgggcgcggttttgcctgatgaaccaaaggcattgtgtgtatctgatttgttgcctgtcgggtagttggatacgctatcaaacagattttcgctgtcgttttcagacggcattggggtggagacaacgccggtaatgtcatgcaacacttcgcctgcgttgccgacgctttcggtcaggttggcgcgtgtgtcggcaagggctttgttgagcgtgtggaacacaagttggtgcacctgctgactgtcgcggaagcggatttcggttttggtcgggtggacgttgacatccacggcttcgggcggcaggtcgagaaagaggacgaaggcgggagtgagtgcgttgtgcaatacgtcgcggtatgcctgcttgacggcgtggagcatcactttgtcgcgcacgaagcgatggttgacgaagcagtattgtttgtcggttttacctttggcgaaagtcggtttggcaatcgcaccatagagccgcagcgcgccgttgccgctgtcgattcccaatgatgccgtctgaaagtcttcgccgacaatggcggcaatccgttcatgcaggctttgtgcagggagtttgaacacttgtttgccgtcgcgtttgagcgagaaggcaatgtgcggatgcgccagcgcgaggcgttcgagcatggtggcgcagtgggcgtattcggtgttttcggatttgaggaacttgcgccgtgcgggggtgttgaagaagagttcggcggcttcgatggtggtgccgacggggtgggcggcggcggtggggctgctgagtttgccgtcttcggctttgacttgggtcgcgtgcgaactgtcgttctgacggctggtcagggtcaggcggctgacggaggcgatgcttgccaaaccttcgccgcgaaagcccatactggcgacgtgttccaaatcgtttaaggttttgattttgctggtggcgtggcggtggagcgcaagttcgatgtcgtcggggtggatgccgccgccgttgtcgctgacgcgaatcaggcggatgccgccgcccgccagctcgacttcaatcgccgttgcgcctgcatcgatactgttttcaacgatttctttcaaggcgttggcagggcgttcgaccacttcgccggcggcgatttggttgacaagatggtcgggcagggcggcgattcgggacataaggcgggcttccgttgcaaaaaacgtcttattctataataaaaccccttatctttctgcccgtattcttgataaaagccgtttatcccgtttggaaaataccagtataatcacgccatattccgtaaaattggagcacaaagatgtatcactaccaatccgatgccacacaattcctcaaccgcctgattgaagaaaaacctgagttggaacagcagcgtttggaaaacagggggcttttgtgggatgtcgaactcaatcccgaagaacaggaaaacttcgaggcggcaaaagtggcgaaaaaaccttatacctattaccaagactgaatccgccgaaatgacgacccatctgtccaatgtcgcaccggacctgcaaaactatttgaacgccatcggcgaacccgaacatcccgttttgacgcggctgcgcgagaagaccgggcatcaccgtatgggcaaaatggcgattgcgcgcgaacaggcggcagttttggtttggctggcaaagctgatccgtgcggaaaaatatctggaaatcggcgtatttaccggatacagcagcaccgcgcttgcattggcactgcccgaacacgggcggattaccgcctgcgacatcaatgtaacctttaccgatacggcgcgtcaggtttggaacgaggccggtgtggcacataaaatcagcctgcacctgcaacccgcattgctgacattggatgatttgattgcacagggtgaagccggaagctacgatttggcactgatagacgcagacaaaccgcccacgccgcaatatttcgagcgttgcctcaaactcgtccgtcaaggcggcatcatcgccatcgacaatattttgctgaacggaagggtgatgcgcgaagcggcttccgatgcgccgcccagcgtcggcatcctcaaagatttcaatcaaaacctgccgaacgacccgcgcatcgtccccatcaccctgcccgtcggcgacggcttgaccctgcttctgaaaaaataatgaagatcaaattaccgctttttatcatttggctgtctgtgtccgcctcctgtgcttccgtttcacccgttccggcaggcagccaaaccgaaatgtcgacacgggaaaatgcttcagacggcattccctatcccgttccgaccttgcaagaccgtttggactatctggaaggcaaaatcgtccggctgtcgaacgaagtggaaaccttaaacggcaaagtcaaagcactggaacacgcaaaaacacattcttccggcagggcatacgtccaaaaactcgacgaccgcaagttgaaagagcattacctcaataccgaaggcggcagcgcatccgcacatactgtcgaaaccgcacaaaacctctacaatcaggcactcaaacactataaaagcggcaagttttctgccgctgcctccctgttgaaaggcgcggacggaggcgacggcggcagcatcgcgcaacgcagtatgtacctgttgctgcaaagcagggcgcgtatgggcaactgcgaatccgtcatcgaaatcggagggcgttacgccaaccgtttcaaagacagcccaaccgcgcctgaagccatgttcaaaatcggcgaatgccaatacaggcttcagcaaaaagacattgcaagggcgacttggcgcagcctgatacagacctatcccggcagcccggcggcaaaacgcgccgccgcagccgtgcgcaaacgatagtttttccatttttccgctttttaccccatccgcaccaaggaggatttatgatacaaatcggcatcatcatgggcagcaacagcgattggcccgttatgcggcaggcagcgcagtttcttgaagagttcggcgtagaatatgaggcgcgcgttgtttccgcacaccgcaccccggatttgatgttccaatacgccgaaaccgcacgggcgcgcggcatcaaagccatcatcgcgggtgcgggcggcgcggcgcatttacccggtatggttgccgccaagaccaccgtccccgttttgggcgtacccgtccccagcaaatacctgcgcggcgaagattcgcttttatcgattgtacaaatgcccaaaggcgtacccgtcgccacattcgccatcggcgaggcaggcgcggcaaatgccgcattgttcgccgtttccatgctcgccaacgaaacccccgaactggcgcaaaaactggcagacttccgagccaaacaggaacaggctgttttgaatatggaattggaacaaatttaaaacccaccgtctgcgaatatatagtggattaaatttaaaccagtacggcgttacctcgccttgccgtactatttgtactgtctgcggcttcgtcgccttgtcctgatttttgttaatccactatacaaatgccgtctgaagccctgtttcgggtttcagacggcatttttgcgaacaactttttatgcctgttctttttggcgcattttttctgccattagttcgtgcagggttttcttcgccggtttcatcggcacgcggttttgcgtccaacccaactgtttgcgcggggtcaggttgcggaacttggtggctgcccaaccgaaggcgcggtaggttttgctgccgctgaaaataccgttgaatgtgcgccacgccatttgttcgccgaaggtatgcgatgcgccttgcccccggatggggtgcggcacggtttcggtcggcgaacgttgcgcttcaacgcgcaaacgctgcatttgttcggtaatcgggatgcgtaccggacaaacttccacgcacgcgccgcacatcgtgcaggcggtcggcaggtcgcgagtggcatccaagcctaacaggtgcggggaaataatctcgccaatcggaccgggataggttgtgccgtatgccgcgccgccgatgcgggtataaaccgggcaatggttcatacacgcgccgcaacggatacattgcagggtgcggcgcatttggtcttcggcataagcctggctgcggccgttgtcgagcagaaccaagtgcatttcttgcggaccgtctaattcttcactgcggcgcgggccggtaatcatattgaaataagtggtaatgttctgaccaatggcagaacgcggcagcaggctgtacaagggtgggatgtcggacaatttcgccaccactttttcaatgccggtaatagcgatatgcacgggcggtacggtggtactcaagcgaccgttgccttcgttttccaccagacacagcgtacctgtttcagcaacggcaaagtttacgccactcaaaccgacatcggcagtgctgtaaatatcgcgcagtgctttacgggcgaagccggtcagttggtctacatcgtctgtcagcggcgtaccgaggttttggtggaacagttcgctaacctgttctttggttttgtggatagcaggcatcacgatatgggtcggtttttcgcctgccatttggacgatgaactcgcccaagtcgctttctaccgctttaatgccttttgcttcaagataatggttcagctcgatttcctcgctgaccatcgatttgcctttgaccatcagcttgccgtttttggctgtgatgatgtcgtggataatttggcaggcttcggtcggggtttctgcccagtgcactttcacgcccaacttagtcaggttttcttccagctgctccagcagggctggcaatttagacaatgagcgctgacggacgtgttcgcacaaatcgcgcaggctttgcagctcttcttcgtcggtcaaaacggctttgcgtttggtcatcagcatatccatcgcggtacgcaggcttttgcgcaaaggcttgtcttgaagggaaattgcggcgttttgcttgaaagtttccggcttcatgtgaaatttgatggtttgcgtagtcatgcgttttcctccaaatcggcaggggaaatgtggtcgggcaggatggcgaggatgaccaaatcgcgcgggccgtgcgcgccgtaagcaagcgtcagttggatgtctgcggttttggacgggccggaaatcaggaatacattggtcggcataccgttttccaccagtttttcgccttcgacggcattatgaaactcgttgtacatcttggacgtatcgaacaggcagaaatgcacgggcggaacgaggcttaaagtacgcggttcttcggggctggaaaacagcatcagcgtgccggtgcgggcgatgccgcattgcgcgccgctgaagcccgcatcgatgttcgtgaaaaactcggttttccaagtatcgatttcgcgctcgaaggcaatcggttcgatattgctgtccgccaatgcggcacgggcaatttgtccgtgttcggtcgccaagggcagcaggatgtttttcaaacccttgccttctgccgcttcgcggaaaacctgcatccaattgcttttcgtcacccaataaatttcggttttgaccgcacgcatagcggcagcccaatgtttcagacgctcaacttcgctgccccaagaaacacccatttcacggtaataatcaaaaaccgcaggttcttccatcggcaatgcgtcggcttttttcagttttgccaaaatattttcacgcgcgctcatgctttgcctccggtgcgttccaacaagaaggatgcgatatgtttcggacgcggcatatccggctcgtccttggcgattttgccgccgatgttcatcatacagccgcagtccgcgctgatgatttcggttgcgccggtttctttcagcgcggcgactttgtctgttaccattgcgccggaaatatcggcttgtttgacggagaatgtgccgccgaagccgcaacattcgctttcgtggtcgtggacgatgcgttcgacgttttccataccgtcaatcagttgccagcctgaaagatggacattcatttcgcggcgggcggcgcaggaagtgtgaacggcgactttgagcggttcgcccttgtcttcgggtttgaaaccgatggcaagcaggaaatgggtaaactcgatgatgcggccggcgcaatccacagccctttcctcgtactcgctgcctttaaacagcgtcggccagtggtgtttcatcatgccgccgcacgagccggacggcacgacgatcggccagttttcagggaaaaggtcgagttgtgctttggcgacatcgaaggcttcggtcggatggccggatgaataggcaggctggccgcagcagctttgcgccatcgggaaatggacgcgtatgccctgctgctcgattagggtaatggcatccatg

SEQ ID NO: 37814 - DNA, 65632 bp, Neisseria meningitidis
ttttacaagatgccaagagtcatctgtcatttccatctcaactagcacataaccaggatatgactttctttcactaatagtcttacgaccattgcggatatcaacaactttctctacaggcaccagaatttgtccgaaataatctcccatctcctcacgggcaatgcgctcttccaatattcgttggacattcttctcaaaccccgaatacgcctgtacaacataccattttttcgacatctcaaccttcccttctcagcaatacatcaaaaaataaccacgaaattgctgtatctgccgcatagataaatatagaaagcacagcaacaaacactataacaaatacagtcattctgacagcatcttcacgcttaggccaaaccacctttttgaattcggaccaagaatttgagaaatatgcaaaaaacccttccttaccggaattagatgcagattctttatcttgaacaaccagttgatccactttaacgttctttttttcaggcgtatgttctgtcatattatttatccatcatagcatctgtctattctcaatccatgtaaatggcaagagagtttactaaataacaaatacaaaaaaattaaccgacacaaggccggttaattttttatttggcaggccaagagggtctcgaacccccaaccctcggttttggagaccgatactctaccaattgagctattggcctctaaacttaagcgataacagaagaaaccacgccggcacccacggtacggccgccttcgcgaatcgcaaagcgcaggccttcttccatagcgataggcgcaatcagttctacggtgatggttacgttttcacccggcattaccatttctacaccttcttccaaagtaaccgcgccggttacgtcggtggtacggaagtagaattgcggacggtagttggcgaagaacggagtgtgacgaccaccctcttctttgctcagtacgtatacttctgctttgaatttggtgtgaggagtgatagtacccggtttagccaatacctgaccgcgttccacgtcttcacgtttggtaccgcgcagcaatacgcctacgttgtcgcccgcctgaccttcgtccagcagtttgcggaacatttcaacaccggtacaagtggttttttgggtttctttcagaccgacgatttcaatctcgtcaccaacgtggatgataccgcgctctacacggccggttactactgtaccgcggccggaaatggagaacacgtcttcgataggcagcaggaacggtttgtccacggctcgctcgggagtcgggatgtagctgtccaatgcggcagccagttcgaagattttttcttcgtaagcggcatcgccttccaaggctttcagtgcggaaccttgtacaatcgggcagtcatcgccggggaagtcgtagctggacagcaggtcgcggatttccatttcaaccagttccaacagctcggcatcgtcgaccatgtcgcatttgttcatgaacacgatgatgtaaggtacgcctacttggcgggccagcaggatgtgttcgcgggtttgcggcatagggccgtcggctgcggaacataccaggattgcaccgtccatttgtgcggcgccggtaatcatgtttttaacgtagtcggcgtgccccgggcagtctacgtgtgcgtagtggcgggtttcggtttcgtattccacgtgcgaggtgttaatggtaataccgcgtgctttttcttcgggtgcgttgtcgatttggtcgtaagcttttgcagcaccgccgaattttttagccaaaatagtagtcaaagcggcagtcagggtggttttaccatggtcaacgtgaccgatggtgccaacgtttacgtgcggtttgctacgttcgaatttttccttagccatggcaatatcctatatatctaagccttaaagaaatgaataatcgagagatggtgcccatgggcagatttgaactgccgacctctcccttaccaagggagtgctctacccctgagctacatgggcctaattgtttggagcgggtgaagggaatcgaaccctcaccgtaagcttggaaggcttctgctctaccattgagctacacccgcattactcgctactgccccaagtaagaattttggtggagggagaaggattcgaaccttcgaagctttcgcaacagatttacagtctgccccctttgaccgctcgggaatccctccaaaagagaacgttagtttattagcggcttgcttttccgtcaagtttttttttgattttatttcaaaacagacataatttgatgttttaaaaagaatttatttaaactggataatcttttcgtatttcgccatcaactcgtcatgggtttcgggatgttcttcgtcaatcaggatgcagtccaccgggcaaacctgctggcactgcggctcatcgtagtgtccgacgcactgcgtgcagaggttggggttgatttcgtaaatttcctcgccttgggaaatggcatcattggggcattcgggttcgcatacgtcgcagttgatgcactcgtcggtaataaaaagcgacatttcttttccttttccactaaattatcaaaaccgggcgggcgcggattatagcacaaggtttttttgaaccggacggttgcaaacgaatgtttacaactcggaaatgattatcaaagcgcatattattcagccacttggaaaacccttaattcaaatgtactctgccccgatttcccttctctatattccgtcagccaatcgggaatattcggcagcgtacccgcctcgagatagacgaatgcccgggggttcaggcacggcttcaaggcatcgaacaggatttgccagtcctgccatgcaaacggcgggtcgagaaagacaacatcaaactgttcggatacggtcttcaaatatgcgatgccgtctgaaaagacgatttgcacctgccccaaacccagttcgcgactgtttttctgcaaggtctgcacggtttggcggttgttatccgaaatcagcacgcgtttggcgttgcgcgaagcggcttctataccgagtgcgccgctgcctccgaagagatccaaaaccgttttacccgtcaaatcctgtcccagccagttaaacagcttttcacgcacgctgtcgggtgtcggacgcagtccgtcggcggatgtgaaactcaatttcctgccccggcattgcccgccgataatgcgtacccggttgctgtgtttggtatgtttgcctgccgccataatcaaaaacctgtaagttcaaacggtattatacaagacctgtcaaagaatatgccgtctgaaaacttttttcagacggcatatctgtttaaacggtttcggtcagcttgcggagcagctcgatttctttgtctttttgttccaacatttctttgcagtgtttcaactccatttttaaaaattctattttcatcgaaacatcacccgacgcatacaacgcaatatcgccaccactatcaccttcattaatctgaaacaccatcccaccaccgcccgatttgagcaagtcccacatatcgattttgaaaatctgagccaactgctccaaacgcgggatatttaactgcgtttcgccccgttcgattttggcatacccgcctgccgacatcgccagcttttccgccatatcctcctgggaccatttattcaattcgcgcatcaggcggattttttcgtgggtttccataagctgaactttctgtatagatggttgaattattgggatagattttaaacttcttctggctggttaggcaattaactattagataagattttttcctttttacaaaaaaagggaaaacatggaattcctatctcttcacccttggtggtctttttttattatattaactattatccttagctatattggattctgtgcacatctccacattcaaaatagggcagttttcttttatagctatcgggatgtaactattattttcttgacacctgtcatcctcatcgctctaagttatttaattaaaaataaagaaatcctgtcagcttgtatcttatgtataactcttattgcattttcatgggcatggattataacctatcgatctaatactaaaaggttttttctttccttattgatagtatggggaaaattgttattaagtactattgtttgggcaattctcgccatatcacttggcttagctgtaataacagggaacagcaagcgtaaaaaatatgaacgacgtgaccgtcatgctgaacgtaatgaaaaagcttttataggtgcgctattagtaggtttcgaattatcaagaaatttattgaatttatgttgcctacacaaggatttttccaccccatctaaaaacattgaagtcaatcgctcttaaattttaaaaggaagagttcatgatgaaggatttgaatttgagcaacagcctgttcaaaggctacaacgacaaacatggcttaatgatttgtggctatgaatggggttggagtaaagccgatgaggctgcttatgtagcaggtgaatacaaactccctgaaaacaaaatcgaccatacatttgcaaacaaatccctctatttcggagagcaggcaaaaaagtggcgttacgacaatacgataaaaaattggtttgaaatgtggggacaccccttagacgaaaatggattgggcggtgcatytgaaaaatccctggttcaaaccaactgggctgctacacagggcaacactatcgacaatcccgacaagttcacacaacccgagcacatcgataattttctctaccacatcgaaaaactgcgtccgaaagtcatcctcttcatgggcagcaggttggcggattttctgaacaaccaaaatgtactgccacgcttcgagcagttggtcggtaagcagaccaaaccgctggagacggtgcaaaaagaatttgacggtacacgtttcaatgtcaaattccaatcgtttgaagattgcgaagtcgtctgctttccccatcccagtgccagtcgcggtctatcttacgattacatcgccttgtttgcgcctgaaatgaaccggattttatcggactttaaaacaacacgcggattcaaataaaccaatcacagaaaagcaaaggtcgtctgaaaatttttcagacgaccttttctctttcaaaccaacctaatcttactccttcggcgcgggcggttcaatctgttctttccagccgcattctttttgtgggcagactttttctacaccccagcgtttagtggttttgatggtcaagaccggccaatggcagttcaggcattcttcggcaacgggcgggttccaagtggcgtagttgcagtcgggataggtgctgcaactgtaaaacagtttgccgtagcgggatttgcgctcgacgaggttgccttttttgcattgcggacactggacgccggtatctttcggtttttccagcggctcgacgtgtttgcatttcggatagttgacgcagccgatgaatttgctgccggtgcggctgtatttgtacactaggcgaccgccacatttcgggcactcgcgtccgtcgagttcggcctgttcggcttcggctttggcgatgcgttcggcagcttcttcggcggtttcgttgacattgcgcgtgtagctgcactcgggataaccggcacacgcaacaaaacgacccattttgccgaatttgatttgcagtttgtgttcgccgcatttcgggcaggtttcatcaagttcctgcgtggtaaatttggcgcgttcgatgccttctttttcttccacttgtttgatgaacggtttccagaatttgtccatcaagggaatccattggcgtttgccgtcggcaatttcgtcaagctggtcttcgagtttggcagtgaagtggtaatcgacgtattgggcgaagtgttcggtcaggaatttattgacgatgtcgcctgtgtcggtgggcataaagcgtttttgctcaagggtaacgtattcgcggtctttgagcgtggagatgatgctggcgtaggtcgaggggcggccgatgccgtattcttcgagggctttaaccagcgtggcttcgttgtagcgtggcggcggagtggtaaagtgttgttcgccgtagagtttgtccacgggcaatttgtcgccttcgctcatttcgggcagttttttgctgtcttcgccttcttcatcgtcgctgctttcttcgtaaacgctgaggaagcctgcgaaggtttgcacttgtccggttacgcggaatacgcctttgccgacggtaatatcgacggtggtttggtcgaatttggcgggcgtcatctgacaggcgacggtacgctgccaaatcatttgatagagtttgaactggtcggcgctcaggaagggtttgacgctttcgggcgtgcggtacacggaagtcgggcggatggcttcgtgcgcttcttgggcgtttttggatttggttttgtattgtttggcggcactcggcagatattctttgccgattttgttttcaatgtaatggcggatttcggttaaggcttcatccgccaagttcacgctgtcggtacgcatataggtaatcagaccgatggcaccctgccctacgtcaataccttcgtaaagctgctgggcggtacgcatggtgcggtcggtggtgaagccgagtttgcgcacagcatcctgctgcatggtggatgtggtaaacggcgcggcggggttgcggctgcgctttttcttttcgatggcggtaacgacggcctctttgccttcgagttctttcaacacatcggcttgagcggcttcgttcggcaggtcgaattgttcgagtttcgcgccgttgtattgggcgagtttggcggtgaacttgctgcggcctttgtggctgtctagatgtaccgtccaatattcctgcgcttcaaacgcgcggatttcgttttcgcgttcgcaaatcaaacgcagtgcggggctttgtacacggcccgcgctcaaaccgcgacggatttttttccacaacaatggcgaaaggttgaaaccgaccaaatagtccaaagcgcgacgggcttgttgcgcatcgaccaagtccatttcgatttcgcgcggatgggcaacggcatcgagcacggcgtttttggtgatttcgtggaacacgacacgctgcggcttgatgtttttcaagccgcgtttggatttgaggatttccaaaagatgccaggaaatggcttcgccttccctatccgggtcggtggcgaggtagatgttttcagcttctttggcaccggcgacgatggcatcgacgtgtttgccgttgcggctgatgagttggtatttcatcgcaaagccgttgtcgggatcgaccgcgccgcttttggggacgaggtcgcggacgtgtccgtaggatgcaaggatttcaaaatcgccgcccaaatattttttcagggttttggctttggacggggattcgacgattaataggtttttcgccatttgtcgttctctggatggtggttttgatgccgacgtttcagacggactcgggcgggccgtctgaagccgcttcagttcatcgtgggtttgttgtcgagtaaaagcgcgctcatcagctcgtcgccgaccaacacgggcagctcgctcttgtttgcccataaaagcagcagggtcagcactttggcggtatctacggtaatttcgtcgcccggaatgtgcatgagcgcgtggatgatgatttcccgctgttcgcagctgacggctttttcttcaatcagatactgcatcagccccatcacttcctgcggcaggttgtcggtttcttctttgctgtacacgcgcaatgcgccgctgtcggcgggttcggcggaaaattcggagctgttgagcaatacttccatcatcatcagggtgttgccgatttccatcgtatcgaaacccgcttcttcaagcagcatacccaagtcttcgggcggcgggcaggtatcgaaatcttggaaatgttcgatgaggtaggcgatgacttcggtcattcgtgttccttaatataaagtgcgttcaagttcggatacgctggtatctgccgccgggcattgcggcaacgctgccgtccaattccaattccaacagtgcggcatacaaatctgcggcaggcatagccaactgtccggcaagcacgtcgggatgaactgggtcgaaacccatcctgtccaagatactgccgccgacgggtcggttctccgtcttttcagacggcattttgccttcaggcagagacagctggtcggatgccgtctgaacggcagtgatgcgcttttcaggtattcccttatttatagaatatgatgaagcacccgtattttgcaatagccccgggcattcgttcaggatgtcgtccaggcattccaccaattttgcgccgtctttaatcagtttgtggcagcctttactgtgtggattgtctatcgagccgggtaccgccatcacttcgcgccccatctccgccgccaatctggcagtaatcagcgaaccggattccaacgcggcttcaaccaccagcgttacttgcgacagggcggcaatcaggcggttgcggcgcggaaaattgccggcatacggccgcgtgccgatggggaactcgctgacaatcaatcctttttcggcgatttcataggcaaggtttttgttgaccggcggataaatgcggtctatgcccgtcccccacacggcgatggtgccgccttctgcctgcaacgcaccctgatgggcggcggtatcgatgcccgaagccatacccgacacaacgggaatgcctttcccacccaacgacttgccgaaatctttggcaatccgcatcgcctgcggcgtggcatgacggctgccgacgatggcggcggaaggtttgtgcagcagttgcacgttgccgcgcaaaaacaaaaccggtggcgcggtcagcccctgcgtcagcatttcgggaaaatcttcatcctgaagcagcatcaggcggcatccgtcccgcatttcccattccaatgccgcttctgccgcctgccgcgccagagcgcgtttttccgcattgcgccaagcctcaagcgcctgtttgtgccgtatcagtgccgccacctgttccgccggtgcggacagggcattttgcgcgctgccgaaacggcgcatcagcagcaggaaactttccgcgccgatatagggcgtaaacgccaattgcagccacgcgaaacgttcgtcctctgtcataaaatccgtccccttacgatttcagacggcatttgcaccaaatgccgtctgaaaacaaaagcccgcagccggtaaaccggccgtccgggcctattcttcggttttttcccccgcccggcgcgaaacgccgatgccgagctgtttgagtttgcggtaaaggtgcgtgcgttccaaaccaactttctgcgccacttggctcatattctgaccttcttgggcgatgtggtactcgaaataacgccgctccacctcctccctcaattcgcgcaggggcaggttgaaattaaacccgcccaccatatcttccgccccctcggcaggcacattctgccccaaaagggaagaaaccgcccctgcgccgatttcctgtccgtccgcctccaacaacagcgttgcaacgacgctttgcagttggtcgaaatttcccggccagtcgtaacgggtcaatgcggcaagtgcctcttcactgaatgaggcaggcgcaatcttttggctttccgccacattgcaggcaatcccctgtatcaggaagggaatgtcttcatgctgcatacgcagcggcggaatacggacgaccgattccgacagcagttccgccagcttttcctcgcaggcaatgccgtctgaacctgccgccctgctgcccgatgcgaccaccctgacgcggcggtgttccgcctttccgacaataaaggcaataccggcttggatgttgcggctgtactgggcgatgtcgccgacatacaaaacgccgccctccgccttctgcaacagttccatcggcatatcgatcagatattcgacccttgccgggctgacccacggcgtaccgtttttatggaaatagcgtgccaccgtttcaaacggcgaacccgcctcgcccgtcaaaagtacgggagaggcacatttcaccgcagcccctacctcacggttcatttcctgaatcgccgcactgttgcccagcttgtcgaatacaggccccgtttcggtttgcgccgcaccgtacttcaacgcgttttcgacggcagacagcagcttttgcagggaaatcggtttttccaaaaaatcgatcgcgccgattttggtggcttccacggcggtatcgatgctggcatgcccgctcatcatcaccaccggcatattgagctgcccgtttttcgcccactccttcaaaagggtgatgccgtcgcaatcaggcatccaaatatccagcagcaccatcgcggggcgcgcctgatggcgcagcttgcgcgcctcttcggcgttttccgccaatgcgaccgaataaccttcgtcctgcaggatttccgacagcaggtcgcggatgccgatttcgtcgtctacaattaaaatatcgctgctacgcataagtttttaccgtttttggcaagatgattctgacacacgcgccacccgcatcctgattgctcaggctgatgcggccgccgtgttcttcaatgatttttttcaccacaggcagacccaatcccgttcccgccggtttgtccgttacatacggctcgaaggcgttgtgcagcatttccctgccgaaccctttgccgttgtcgcaaaccgtcaggacaatccgaccgtcctgccctgtttccgattttaccctgacttcgggcacatcggcttcttccgccgcttcggcggcatttttgaaaatattgtgcagcacctgccgcatggcggtcgtatccgccgccaccgtcagcggttcgccggcaagctccgccgcaaaccggcacggaccggcttcatacaatgccaacacatcgccgattaaggcgttcaaatcctgattttccaatttgagcgaaggggaacgcgcataattgcggaatgcttcgaccatttccttcaatgccgccacctgtttgacgatggtgtcggtcgaacgcgtcaggatttgcgcatcctgctcatccagcttcccgcccaatttccacgccagccgttcggcggaaagctggatgggcgtgagcggattgcggatttcgtgtgccagccgcttcgccacttcgccccacgcggcttctttttgcgcgtgtatcaaaacggtgatgtcgtcaatcaccattaccacgccgttgccgttgtcttcgggcaggacggttgccttgcccagcaggattttggcatcgtccggcgcggcatatttcacatggaccggtttgtccgtacctgccgccgcgccgatggcggcaaacacttcggcaagcagggactgctgcgccgaaacgccgtgccaaccgtgccggctgctgccccacaggggggtaagcggcatccccaaaatctgttccgccgctttgttgaaggttttcagacagccttgttcgtcaaacaccaccacgcccgtggtcagcccctccaacacgcattcaagataatgcctggcggcttcctcgcgccggcggttgcgctcgtctgcttctttggcgatggaaagctgctcggtcatgtggttgaacaacttggtcaagcgtccgaactcgtcgttgcgcaacacggggcgcgtctggctgaaatcgccttgcgccaccgccttcgccccctcggcaagcgataggacgggttcgacgaaacggcgggcgaaatacagtgccatgaccagtgcaagaaaaatcgacagcagcgaggcaatcagcagggttgccaggaaaaaggtctgcaaaccttttttgctgtaactcaactcagcatatttcgcccttgccttttcgattaagacggcatcctctgccacgcctttgggaaccggctgacggaaaaacaaggcgtaatcgcgcccgttgtgcgtacccgccgacagccagccctgcgcgtacaatacgccgcctatgctttccaaatccctgaccgaacccgcccgttggattttttcccaacgcgccttacctggaaacggctgatcgagcttgtgcgggttgatgcttttttcgattttgccgcttgcggcattgtacagggcaagctgggcaaaaccgctgccggcgtaatgttccagcaccctgcccatatccccgggcagggaagccgcgccgatgaggtctatctgcacggggacggcgttgccgagggcgttgtctgccgccaaattcaatgcggacttgctcaaattgaggctgcgttcaagcgcctcgtgggtatcgttgccgaaccacgaattaatcgtgccgttgatgaactgtgcggaaacgccgaacagaaacacgccgggcagtacggcaaccagcgtaaacatcccagaaaggcgtttggcaatctgcgaaccgaatacgccgtcgcgcctgtctttcaacagcaatatgacataacgtgccaaaacggcggacaacaccagcagcagcattgcgctgaacgcaacaatccaccagaaataatccgccagcgaactggtgctgccggttgccgccgtcagtccgtacaacaggacgacggcgcatatggctgcgatcggtagaaaacggcgcattatttgttcccgatgatgtttagaggtttccaacccgaatccaaatgccagttttgagaagtcaatgcattgatttgaaaaggcttgggcagttttgaagtggacagcgtcaggcggatttccgccttggtttcccctgcttccgcaccggacagcgcgcctttgttcaggactttccagttggcaaccgcgccggtcgcgcgcaatgccgcatccaaggtgtcgtagtctgtcgaaaacgcgccgacggtaacgcggtagcggttggtcagcggatggaaactcagtttgtagtcaatattgtcgtcatcgccaatcagttgccccaatttaaaccgataagaagcgattatcggggcggaaagctgccagcttaaggtaaagttgagcggcacgccccggcgcaacgcctgttggagctggtcgggcagctcggtttggaagcggctgctgatggaaagctgcccgccgtcggttatcctcgcttcggcacggctcacatctatcccctccgccgccacattctgaaaggcggggagcatcagcggcacaatcagccatttactgcttttgaataagcgcgtaataaaagccatcttggtgtttgttcggtaagagtacccgcgattcgatcagttctgcatcggcatggcggttgaggaatttttgcaattgtccgtcgttttcctcgacgaacacggaacaggtagcgatcaacatccttcccccgcttttcagcacctgccacaatgcatctagcagggcttcctgctggcgggcggttttgagcgcgtcggtcggacggcgtagccatttcacgtcgggattgcgccgcgccacgcccgaggcggtacacggcacgtcggcaaggacggcatcaaacggtttcccatcataccatgccgacaggtcctgtgcatcggcacacgccgtcgatgccgtctgaaagcccagacgcgcgatattgtcttccacccgtttcagacggcctgcatcaatgtccaaggcggtaacacggcaatccgccagttccaagatatgccccgtcttgccgcccggcgcggcgcacgcgtccaaaatccgttcgccgtctttcgggtttaacaaatacgccgcctgctgcgcgccgaagtcctgtaccgaaacaatgccgtctgaaaaaccaggcaggcggttcaccggcacggcttcttccaacgtaaccgcatattcgtccaacgccttagccgcgataccttccgccaccagtttttccaaatagctttcggcattgccgtgtcggcggttgacgcgcaaagtcatcggcggatgggattgcagcgcggcggcgatgttgtgccagtgtttcggataatggtttttcaagtaagccacccaccacagcggcaggttgtgtttcgctacatcgtcttttttacaggaagccacaagcttgtcgcgttcgcgcaaaaagcggcgcaaaaccgcgttggcaaacgaacggtactgcccgcgtccgattttcgcgatgctttccaccgcctcattgaccacggcgtggggcgcgttgcgcgtgtaatgcagctggtacaacgccgccaaaagcaggctttcgagctgcggattgccaatcggctttttcagcatctgcgcgagcatatgtttcaaactgcccaaataacgctggcagccgtaggcgatgtcctgcaacgcgccgttttcctgcgccataaggtcgggatgcgcggtgcggatttgcgccaacacgtcctgaaggttacgtccttcggcaaccgccgcaatgctgtcggcggcaagtttttgggcaagtgccatactcatattatgtgattcgctttcttcgactgatggtttcagacggcattcccgtttgcggatcggaatgccgtctgaagggatttacagcttcgcccctgcttcgatatgccgtcctgctgcaaacgccgcgatattcatccgcctgccgccggcaggctgcaattcggtaatcttcagcgcgttttcgccgcaggcaacgaccaaaccgtccgccgaacaggacaacacttcgcctgccgcgccttgttgcgccaccacttccgcccgccggattttcatcggcttgccctgatactcaacccacgcggcaggcacggggttgaaggcgcggattttgcgttcgataaccgccgcgcttttgctccaatcgatacgcgcctcttctttgctcaatttttgcgcgtaagtaacaccttcttcgggctgtttgaccgcgttcagacggcctttgctttgaagctgttgcaaatcggcaacaaccgccgccgcaccgatttccatcagcgcgtcgtggacttcgttggcggtatcggtcggttggatggcgtagcggtgttcgctgaccacatcgccggtgtccaaaccgatgtccatctgcataatacacacgcctgtctcggcatcgccggcttcaatcgcgcgttgaatcggcgccgcgccacgccaacggggtaacagcgaagcgtggatgttgaggcagccgtgtttcggcgtatccaacacttcctgcggcagaatcaaaccgtaggcggcaaccaccattacgtctgcctcgacctctttgagcatttgcagggcttcggcgttgttgcgcagcttttcgggctgttcgacgcgcaaaccgagttccagcgcggcttgtttgacgggcggggcagtcagttgcataccgcgccctttcggacggtcgggctgggtcagcaccagcggaatttcaaaaccggcggcggcaacggctcttaaggcggcggcggcaaaatcgggcgtgccggcgaagatgactttcatagcgtgttcctgcgcgtgcgtaaaattgtcggacaagaccgtgccgtctgaaaactttgcagcgttcagacggcacggcaaaagggtcaaatcgtatgtttctgacgttttttcagcttggtcttaatccgcccctgcttgagttgggaaaggcgttcgacaaacacgatgcccatcaggtggtccaactcgtgctgcacgcaaatcgccaacaagccgtccgcctccagcgtgaacttttcgcctttttcgttcaaagcctcgaccttgacgcgttcggcgcgggttacggtgtcgtaaatgcccggcacggacaggcagccctcttcgtaagtggtttcgccgtctttttcaacgatgacggggttgatgaacacgcgcggttcgctgcggtcttcggtcaaatccatcacgaccacgcgctcgtgcacatcgacctgcgtcgccgccagcccgatgccgcgcgattcgtacatcgtttcaaacatatcggcaatcagcttccggatgcgctcgtcgacttgttcgacaggctttgccaccgtgtgcagacgctcgtcgggatattgcaagatattcaataaagccataattttctctttccttcggcggatacgccgcctgtttttcataattaccgtgatggtgcggataattcgatgttaaaatgcggaacattttttatcacgcggcacatcccgaggggctgccgccgctttttccaacccaatcaagcaagacaaaccgaaatttatcagataaggggaacggttatgcaacgtcgtattataaccctgctctgcgcggcaggtatggcattctcaacacaaactttggcggcaaatttggaggtgcgcccgaacgcgccggaacgctacacggtcaaacagggcgacaccctgtggggcatttcgggcaaatacctgtacagcccgtggcaatggggccgcctgtgggacgcgaaccgggatcaaatccacaatcccgacctgatttatccggaccaggtattggtgttgcgccacgttgacggcgaaccgcgcctcggcttggaacagacagacggcatccccgtcgtcaaaatgagtccggataaggaagtgtccggatacggtattcccgccatcgatgtcaacttctaccgcatctttatgcggcatccgcaaatcgtttcccgcaaagaaaccgctgccgcgccgcgcctgctctcgggcccggaaggcaggctgctgtacaccaaaggcaccagggtttacaccaaaggcctgaaagagccgggccgctacctgacctaccgaatcaataaaaacatcaccgatccggatacgggtaaattcctcgggcaggaagtcgcattcagcggcatcgtgcgctccctcgactataccgactctgtcctcgaacaacgctcgaaacaggctggagaacggccgaaagacaacgaataccatacccgcacccatcctttgattaccccgctgcgcaccccttcgatacagccgctggtggtcgaaaccgccatttccgaaatacagcagggcgactacctgatgaaaatgccggaagacaccgaccgcttcaacatgatgccgcacgaaccgtcccgcccggttcaggctaaaatcgtttccgtgtttgaaggcacaaggattgccggccagtttcaaaccatcaccatcgacaaaggcgaggcggacggtttggacaaaggcacggttttgagcctctacaaacgcaagaaaacgatgcaggtcgacctctccaacaatttcaaaagcagggataccgtcgagctgatttccactcctgccgaagaagtgggcttggcaatggtttaccgcacctccgaacacctgtcgtccgccatcattttggaaaacatctccgatatttccgtaggcgacaccgccgccaatccgggacgcgatttggacaatataccggatcagggccgcagccgcgtgaagtttggcttcaaccgctccgaataattaatcatccgacaaaaatgccgtctgaaacaccttccgtttcagacggcatttttccatcttcaataaaatatccgtttggacttttccgatgtttttgaaatctcctgcaacgcctgattgagtgcgcccaactccaacgccgtttccgaacggcaggcatcgccgaagatgtttttatattccgccgtcagtttcaacattcctttgaacgcgcgcccttccaaagccgccgacaactcgaaaatatcggcgaacacgcgtccataggtttcgcccgaggcgaccgcgtccgtccccaatgcgaacatatccatttttgccaactcggcggcaatcgtgcgcgcgtcttcgtcgtcgggcagcacttccgccttgaacctgacctgttccgccatccctttgccgtggtttttgaccagcagggcgagtatttgcggcttgtgttccaagtgttgcaaagaggcgtgcaggacggggtgtatgctttcgttctgtatcattttttcgcggtagaacttttccgccttggcctttgaacgcgccgacacgaacgcccacgccagccacaccagcgcgacggcggacaatgcggacagaagcggaggcagctcttcagtataggctttctgattgaaccagatttgcgcggtcaaaaaaccggcaaagaaaatcaaaacataaagtatcggtgcgaaacggctttggacagaagcgtgcatcatcattccatttcagattggcaaaacaggcggcagacgaaatgccgcccactcggtttaagggaatccgtcaggcttccgccaccgaatcccggctgtaggttttttcgcagtagtggcatttcagccgcgtctgcccgttgtgctttttaacataaaaccggcttttgaccggctcgccgtggccggcgcaattcgtgttcggacagcggaacacttcggcgatttcgtcgggcaggttcaaatgccgcttctgcacgaccttgaaattgtcgatggtgttgaccaccgcttcgggggcgaacagggcgaggcggtcggcggctttgtcgtccaagcacacgcctttgattttgatgatgtctttgctgccttgggttttgctgggcaggttgaagcccacggttaccgcgttgccgtagtgcaaaagtttgaactggcgcaggatggtcagccccctgccggcgggaatatggtcgataaccgtacctttttcaatggcttcgacactgagtttcggggtttccatatcggttcctcacacttcttcgttcaacaccagcgacaatatcgccatacgcgcataaacgccgttggtcgcctgctcgaaataataggcgtgcggcgtggcatcgacatcgggatggatttcgtccacgcgcggcagggggtgcagcacgcgcaggttcggtttggcgcgggcgagcatagacgcttcgaggttgaatttgccttggattttggcaaattcctgttcgtcgaaacgttcgcgctggacgcgggtcatatacaggatatccgcccattccgccgcttcttccaaactaccgaggatacggtatcggcagccggcttcgtccaactcttcggtaatatagtcgggcatggctaggctgggcggcgaaacaaaggcaaattcacaattccagcgtttcaacgcctgacaaagcgaatgcacggtacgtccgtatttcaagtcgcccgccatggcgattttgagcttgtccaaacgtccctgtgtttcataaatggtaaccaggtcgagcagcgtctgactggggtgctggttcgtgccgtcgccggcgttgataacggggacgcgcgaaaactccgctgccacgcgcgccgcgccgtctttggggtggcgttggatgatagcatcagtatatccggaaatgatgcgggcggtatcggcaagcgtctcgccttttttggcactggtattcgcgccgtccgagaaaccgatgaccttgccgcccaaacgctgcaccgccgtttcaaacgacagcctcgtgcgcgtggacggctcgaaaaagcacgaaccgataagtttgccttccaacaggtcgccgcgcggatgcgccttcagcttcaatgccgtctgaagcaggcattccaactgttcgcgcgacaaatccgaaatggagatgatatgctgtctgtaaagcggattaggcatttttgccccccttccgtaaaaaacccgcgtcaggcgggtatccggttatacgtcgtccacgccgcccgtatgtttgcggaacagcttcgcaaaagcggcaatacggcgcgtattatcgcacatttgccgccgcaaagttttaccgcacgaatcccgtacttttcagacggcatatccaaacacgcccgcataagcataaggtataatcgcgctagacatttcttttcaggaagccgccatgttagtctgcaacccctacgaagtcgtcatccacggcacaacgagttccggcaagattttccgtcccagcgactgggcggaacgcctgtgcggcattctgtcctcgttcaccaaagaccacaggctttcctattcgaaatgggtgcgccccatactggtggacaacatccgctgcgtcgccgtcgataaaaaactggaaaccgacaatccccaaatgttccgcttcctgatggactttgccgccgacaacgacctgcgcgtcatcgactgcaaagccctgctcgaagaacgcgaacagggcggacaaaacaaccctgccgacgaacacgtcatgctggcacaggcaatcgaagaaaaacacgccgccgagaaagcacaggaacagaccgcctcgggcgcatcctacgttttgcgcgaaatcggcgcggacgacaccgccaccgcctttgcagccttgagcgttttgcgttccgccctgaccgacatcaaccgctttaccgaacagatcaacaaagtccaacgcccccaaggctaccgcctgctgggtatttttgaagaaggcaaacacaatgccgtcgccgtctgcggcttccgcgaagcctgcaccctcgccagcggccgccacatccacatcgatgacatcgttaccctgccgcaaagccgccgcaaaggctacgcctcgcgccttttggaagaagtccgcaaaatcggcgcggaaacaggggtaaccaaaatccacctcaacgtccacgtcaaccacgaccgtgccgacgcgcaccgcctgtatttcaaaaacggttttgaaatctgcgcataccacttccgttgcgaccccaaatgaaaacccccctccccatctgcaccctgtcggcactcgccgcctgcaccctttccggacaaggcggcagcagggtttacggcgaaatcaaagcccgagacctttgcgttaccgctcctatcctgctttctgctttctgtcttgcctgctctcgttgagccaagcgttcttgcaagctcgcttgcacgttggcaagcattgcactctatcggctttcttttcctgttgcggctggtggttcaggctcgcgttgtacgctttgcactaaagcgcaccgtgaatcgatgctcgctatttattctatcaatattttgatttataatgaaaaaagttttttcagagtgactctttactttgtaaaaaactttgtatcattctcaaaacctagaaaatcaaacgaaatgatgcaaaaacacaaatgtctaatagattttattttgactgttgccagccaaattgcttatgctgacttacctttaagtttggaagaattattgactgacaagggtaaattcaaactagaaagcagtattagctacatcaacactgaacgcaatcaaagcgaatttgctaatcctatttatgtgcaaaccagcgcaacgaaaattgcaactgtaatggctatgatgattacacctgtaatggcgcaaaatttagacagccaagtttttgacagccaaaatgtgaaagcaattcaattatcacaggctgaaatgaaagaaacacaaggtgaatttgttcccattattgcagccgctgcttttggcggtgcattaggtgcatgggggtatcatggtgctaatttgtataatcatggtaaattaggaactgcgcaaggcgcggctactgcgacaggaatcggtgcggcaacaggagtagcggcaaaacagggctggctgctgctgccggaggcggattggctgggaatttggcatggagaccgggtattcatgcactaggttttggtgccaatgctgccaacaatgcagtcaattctcgaaaataatcattaataacttttagttagctaactaatttccacaatagaattagttagctatttattaatatagagtttgcatgatgatgggtgtattaattttttttctaatcgttccaattttgggatttatttgcgctacgataaattattttattattaataaatttaaacttccaaaatacatggcgtatttactcccatcattatctattttattcatatttattcatgcaataaaattgcatatgattttatttttttatgtttcatgcgtttattccgcgtatacatattatgataaaaaatctttataaattgataaattatgcggctttgattggtttcgccccaaatatagtttttgcttggcctatgtttgttgaccccccgcttcttaccaaaacatccatgtacggagttggaaagcacggcgagattccggcatagtaaaacaagatttggatttttcttgcggcgcggcttcgattgccacgttactgaataatttttatggcagacattattctgaagcggaaatcttagacaaaatggataaaacccaaatgcgtgcttcttttgacgatatgcaacgcataatgcccgaactgggttttgaagcacaaggttatgctttgccatttgaacagttggtacaactaaaaattcctgtaattgtgtatttaaaataccgtaaaaacaaccatttttcggtattgaacggtattaacggagaaactgttttgctggctgatccatcgctggggcacgtctcaatgagcaaatcacaattcttgagcgcatggaaaacacgtgatggcgaaatggaaggaaaaattttagccatcgtgccaaaaaatactgattttgttagaaatcagatgttttttaataagaatcccgttcgtcaaacacgttttacggtagaacaaatccaaatgcggcaaaaacgataataaaccgatttttgcccatttattttatatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataaaagcaaagaaaccgccattagcactacaccccccaagctgcggctgccaaacacatcggctgcttctcgacgcacccgctgaaaaatgcgtcctatccgtccgccttgcccgcaccccctgactttgccgccctgcccgatgccgtctgaagcctgaaccgccccaccagcccgatgacgcacgacaccgccggaaagggcatacacaaagccgtcagcacataacgcgcattccccgtattgaccacgtccgcgcccttcagcagcagcggcagcgcgttcgcccactcccacaccgacggcgcgctgaacgccaataccgccaccagccccaacatccggaacaccccgatttccaacacctgccgccgccgcaccgaacggttgagcaaaaacacaaccgccaacccgaaacagaccaccgccgccataccgccgttggcgacaatctgcaaactgttgaatgcaatatcgggcgtaaccgccaacacgccttccgaatccggcacggcacgctgcaaatccaaaccctgcaacacattcaacacaaaaccgtagatcaaatcaaaaaacaccacgcctatcggcaaagcactcaaaacccgccacatcttcctgtccgaccaaccgttcaaaactttcattttacccgaccacgcaagccgccgaacaaaaaacaaggggctgtcctagataactaggacaaacttgattttactaattgttttaaaatggaacaagaacttttatctcactgttgttaaaacgccattcgcactcctttaaatacagctcaaaatgcgctttgggaatgccgttaaacttgcgtaaatgacgttttgcctgattccaaaagttctcaattccattaatatggttttgtcgttcggcaaaatgtgtgctgtgattgatacgaaaacgaagtttcagcgaagctaaaatggctaaattcgcgcacatctaatacatcatagctacgataacaatccgtataaaaaatgctgtcaggtttcacttgttcacggataataggaaataaagtagcggtttgagtattcggtactgtaaccgtataaaccttaccatttcgcttcaaaagaccgaatacggcgactttaccggcagcaccgcgaccgcgtttgcctttgcgttgtccgccaaaataactttcatctgcttctacttcgccatcaaacatttccaaatgcggactgttttgataaataagtaatcgtaaacgatgaaaataataggctgcggtatttttattaacgcctactaactctgctgccgttcttgcagttacacctgtgacaaacagttcaatgagtttattttgtttatactggcttagacgactttttctcatagggataattctaacttaatttgaatttccctagttatctaggacagccccttaaaaaatatccctttgaaagattttgatgaagtttgtgaaaagtgggagaaatcctttaaagaaaatggaaaagaaattgaatataatcaaaaatattcaagaatttatggtgaagttcgtggagctggctttaatggcgatatcggagaaaagctacatcgttgtgccgtgatggaatgggctgaaaatgagaccgtgaaattagcccaaaaatgggaacaagagcagaaaaaacaacaaattcaacagaaaaaggaaactgaaaaatcgccaaaacacaaagccagtcgtgatgattgggaaatggaacgttaaaccgctattttcatgtattctattaaattatttgaaaaaagacttcactttttgttaaagaaaaatgaagtcttgttctgttcaacctaaattcagaattttatctgccgattgaattgtttcttggcggtgtgcaaccattattttcataataccaagactttttaggttatggttaattttttgttcattttctacatctaaatggctacttgcttcgtctaaaaatagaattttgggtcgtttatacaatgcacgagccaagataactctctgcttttgtccacctgataagatatttcccatatcgccaatcaaggtctcatagcccattggcattttaagtatatcgtcatgtatttgtgccatttttgcacattgttcaatgagctccatatttgggctttcatcaaaaaatgaaatattttccccaatagaacctgcaaaaaggacatcatcttggcgaacaatcccgctcaatcccctaataaaggatggagaaacttgatatatatcatgcccattaatactaactgtaccagtttcaggttttaggctacctgttaaaatgtttaacaaagtggacttcccccgaccagattgtcctgttaaaacaactgcttcattatctttaaattccaaattaatgttttcaaaaagatatggctcattatcagcatatctgaatgagacgttttcaactttaagaaccagttgttcattatctaatttaggtatatgattatacttaataatttcagtttctgtttcatttaaagtaatgtcagccaaacgttcagcatgaagccctaacattttgatttggatgtattggtcaacgagagaagctgttctgctttcaaattgccctttataagccaaaaaagccatcagaacaccgactgtaaatgaaccatctaaaattgcgcttgcaccaagataaattatgataacattttccatgctaaacaacagtttatttgaaaattcaaataaagcagagagtttatctgttgtcagcttggtattgactgtattcacaaataggctcatccaagtgccatgtctttgataatgtttatcaaataatttaactgattggataccacgaatggtttccatgaaatatgagttttgtttggcttcatgaacaatattttcttctgttgcatttcttaatgggtaatatgcaagccaacgaattagtatgtacaaaacaagtgttaaaagaacaatcagcgataattgagtgctgtaaattgtcattaacacgaaagtaaaaacagccattaagctatttaaaactaaaacaaaaaaagtagaagttagtgtttcttggatatgatctattgaaccaaatcttgaaatcacatctcctaaatgtcgtttactgaaatagtcattaggtaagtcaagtaaccttttaaatatattggctttccattgtaaattaagagttgtagataggtgcatacctacccatgcttgtaacaggctaattaactgttgcaggatagtcagtaaaccaaatcccaaagtaagggtcaataataaatttttatcagcagttacaatgacatggtctattacccattgcataaagaatggactaaccaatgcaaagacttccaaagaaatagctaatataagcatttgaattaaagagcgttttaagcctgacccccccttaatagagataatattttgattttctttgtttcttttttctcttcaaaatgggtattggggaataattctagggcaatccctgtgaatttttgtgaaacttcgtccattttgatttttcgcataccgacagcagggtccataatgacgatactgtctttggaaatggaacaaagtacaacaaaatggtttaagttccaatggagaatgcagggtagttgtaaatttgacagctcatctaactctaaacgcaaagctcgtggcgttaaattcatttcattgccaaatctcatgatgtctgcaagatttgcgccctttaatgacagggtgtatttttggcgtaacgttcttaaatcagtgtgaaagccataataggacaagatggatgtcaggcatgctaaaccacattcagcaacttctgtttgcagaatgacaggtagctttttgttaaatccaaaggacagtcttgataaataatccatttttaattgatttttcctgaaatgctgtaaagtgggtcaagtacccattcgtacaattttttcgttcatggagaatatctgcttctaaaatcatgccaatttgaagcggcttgttttctccgtatgctttaatcgtttgtttttccaatttaactttcacaagataggcaggttcatttaataaggttgggttagtgaaaatgatacctaaacctgatagcttttgtttaccgagagcagttctggcaactgaaataatttctcctgtggcatgtccaaatttttggtaagggtacgcttggtaacgtaaaacaactttatctttcggtttaataaaaccaacagctttactgggtatgtaaagattggcgaccaattcagtttgttcagggacaatgcttaacagcaatttagacggttcaacttgttgccctatatcaacattaattgttgatatataacctgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagattatttttgcaaaggtctcaacctgatttactagctcgtatggtttgttcggatttcaaatcaaaatccaaaatttcttggttcatttccgtaatcgcacggttgagttggctcaattcggttttatggcgttcaggcaggctgcttaatgtgattttctgttcatcaagttccctgattgcattattttgttcacgttttaggctctccaaacgtgagcgttgttccaataaatggctttcggcggtcatcttatcttgttgggatactgcgccttgactggctaaaaacttgttcttgttaagggttttttccgctaaacgaatttgacgattttgccctgtaatttgctgtttaatattctctaattgattgtttaaacgatgaatgttgttatgaacatttttttgctcattttgatgaatgcgctttaaacgttccaattcttgtaatgccaaagtttttttaaggttggcttctgctgccaatttggcttgtacgtttcctttttcgccaaaacgcgatgtggaaagtttgaacaatggttcgccagctttgacaaagttaccatcttcaacaaatttatgcgtaatcgtgccgatatcggaagagtaaacacgaaccacccccatagttggaagtaattgaccttcaacggttgttttattggtatagctaccaaaaatcaaaaagataatgatacacagagcaatgagaaaagcgcaaaaagtcagaaataaaaaagagaatggacgggtcaagataacctgacctgtccacttattttgttgggctacaaagacttcttttcggaataagtgggacatttattattatttcttaaaaaaaaatggatagaaaaataccaataattaaaatacttatgcctaataacataaatttgctattgattgatgtttctattttaattacattaaatttaaccaataatccagaaatggttgcagctaaaatgcaaaagacagtggcgtaaatggtttcagtattcataatttttctctttcaaaattgttcaatctaaatagaaaaaggtaacttcaatacatattgctgtaactgaaattaccttttccttaatgatgtaattatcttatggcttcatcatgccacgaccgatattgtatccgccagcaacagagaaaataccagctcccattgcgtcaacccagcctactggtcctgtccacttgttccgttgagctacaaagacttctggtctgaaaaatgagtgattgttagacatgtgtacttatttatgtttctttgattgggataaatttgtaaaaacaaaaaaaaggcaagttgttattatagaagaacttaaaatgcttaacatactcattgaggtttgtaccacataatgagatacgagataatttgttgggagtaaaatcaaaaaaaagattaaatatttaaaataatcactatattttttcattatttgttcctttttgtatttaagttcttatgaaaaactagggtattttgaatagaaaatatcaaaataccctagttttattaaggaatattaccaccaacaagtgcttccatattgtacagcaccagtgattgcaccaccaatagctccgaatttcgcacctggaatagcaccaataccacctgcaaatgaaccaacaattgccccaccagctgctccacctaatgcactaccaatggtattttttgagaaatcacgccagttacaagcagcaccagaaacttgttaaatttcattcaaagtcaaaacttgcataatattcacctttgttaagtgtggttgagaaaaaagtaaattttcatcgttactcattatttgcaatcatgcatatactgtaaccaagcactatattcagttggatcatagtttttcctactgggttgtctgatatgactattggcactattggcacaattgggattagcaactttattgtgagtacctaatggattgatatttcctgtaaagtggctattgcatgcgcttaatgagcatagatttattaatgtcagaaaggataaaacaaaaaatcttaccattttttactaataccaaaagtaggtttcgaaaactgtacaccaagaccttgtacatatccaaattgcttgctaacagaaaactctactccactattgttaggggaataggaagcaccaattttaccaacagcaaccatatcttttttacctaggttgccgccaccctgtgcaaagatatggaatttgccacctgacacttcaactaattcagaggtgtgtaactctttcatgattttctcctgtaaagaagtatggttggaaatgtaaatcagaattaacctttcttaagtttaatttaatactttttttgcaagtattttattttaaattaaatcaatattttaaaaatatttacttgtatactgaaaaagaaactcctaatggtggagtggggcttttgtttaagtaagcattaaaaaaatttaaatttcccattatgattaacttaatgcaagagctttttcaggacgtacaaaccagcgaacgggcgttctgatgtgggcagcctgccgggaagtctgctctattgttcggacaatagggggaatataccaattactttaactacatcattttttgacatttttcttgcctttcaatttaaaatccaaaatcatactgccataatttagcaatccaaaaaaatttaggcagcagtaatggtttcgtattttagaaaacgaaacttggtttggtgttttgaagcatttcagtacacaaacggggctgtcctagataactaagataaactcgattttactaattgttttaaaatggaacaagaacttttatctcactgttgttaaaacgtcgttcgcactcctttaaatacagctcaaaatgcgctttgggaatgccgttagacttgcgtaaatgacgttttgcctggttccaaaagttctcaattccattaatatggttttgtcgttcggcaaaatgtgtgctgtgattgatacgaaaacgaagtttcagcgaagctaaaatggctaaattcgcgcacatctaatacatcatagctacgataacaatccgtataaaaaatgctgtcaggtttcacttgttcacggataataggaaataaagtagcggtttgagtattcggtactgtaaccgtataaaccttaccatttcgcttcaaaagaccgaatacggcgactttaccggcagcaccgcgaccgcgtttgcctttgcgttgtccgccaaaataactttcatctgcttctacttcgccatcaaacatttctaaatgtgggctgttttgataaattaagtcatcgtaaacgatgaaaataataggctgcggtatttttattaacgcctactaactctgctgctgttcttgcagttacacctgcgacaaatagctcaatgagtttattttgtttataccggcttagacgactttttctcatagggataattctaacttaatttgaatttccctagttatctaggacagccccaaaataaatttagcctaagtcataaaaccgtgtaattttgcgccaaaaaaggcggtttgcaggtaaaatatcaaactattaatttaaatcatatttttacagaatattccgccgcgttcatcaaatggacatcaaaccggttccaaatttctgtaattttgtaacaaaataccgcaaaacacccgattgagaccaaaaggactttcatatgaaccagacaagccgcgatctgacccgcatcagccacaacactaaaatcgtcgccacccttgggccgggcagcaacaacgtcgaactgttggaagacatgatccgcgtcggcggtctgaacgtcgtccgcttcaacttcagccacggcacgcccgaattccatcaggaaaacgccctcatcgtgcgcgaggcggcaaaacgcgccggacaggaaatcgccatcattgccgacctgcagggcccgaaaatccgcgtgggcaaaatcgccggcggcggcatcgaattgaacaaaggcgaaacgctggtactggatgccgcgctcgaaggcgaaggcacgcgcgaggcggtcggtttggactaccgcgacctgcccgacgacgttgccgcaggcgatgtcttgtggctggacgacggcctgctgaccctgaccgtggaatccgtcgaaggcagcaggattatcacaagggtggaaaacagccacgtcctgaaaagcaacaagggcatcaacaaacgcggtggcggtctgtccgcaggcgcgttgaccgaaaaagacttccgcgacctgaaaaccgcgattgccatcggttgcgactacctcgccatcagctttgtgaaatccgccgaagatttgcatatcgcgcgcgccaaagtcgaagaagaaatgaagggcagcacggccgtgcgccccggtttggtttccaaaatcgaacgcgtggaagcgattgaaaacttggacgaaatcatcctcgccggcgacggcattatggttgcgcgcggcgacttggcggtcgaagtcggacacgccgccgtccccgccctgcaaaaacggatgatccgccgcgcccgcgagttgcgccgcttcagcattacggcgacgcaaatgatggaatcgatgattaccaaccccgtaccgacccgcgcggaagtcagcgatgtggcaaacgcggtattggacggtaccgatgcggtgatgtgttccgccgaaaccgccgtcggcgcgtatccgtttgaaaccgtcagccaaatggcgattatctgcgcggctgcggaaaaagagcaggattcgctcaacggcgttgccgaacaggtcgagtatcccgaagcggtcagcaccaacctggcggttgccggcggtgcggtcagcgtggcgcgcgcggttcacgccaaagccatcgtcgccctgaccgaaagcggttcgaccgcctttgaaatcagccgccacaacatcaccctgccgattttcgcgctgaccccgagcgtttccgcccaacgccgtatggcgatgtaccggggcgtgcgcccgctgattttggcaaccagtaccgaccacgacacggcgttaaacgaagtcgaaacgatgctggtggaacacaacatcctgcattccggcgaccaatacatcattaccagcggttcgcaaatgcgcgaatccggttcgaccaacacactggaagtgctgcgcgtcaaataatccgccctgagtggaaaatgccgtctgaagccgatgcccgaggcttcagacggcattttttgcggcggcgcggcggttcgggcaaactctgaaaaaattgtgcaaatccggcaacatcggataaaatcgagtacctatactaaagcgaaacaaggcatttccgactgccttttttatagtggattaaatttaaaccagtacagcgttgcctcgccttgccgtactatctgtactgtctgcggcttcgtcgccttgtcctgatttttgttaatccactatatttatccaccgtccgcctttttacggaaaccgaaatgaccccttccgcactgaaaaaaaccgtcctgctgctcggcactgcctttgccgccgcatccgtccacgcatccggctaccacttcggcacacagtcggtcaacgcgcaaagcacggcaaatgccgccgccgcagaagccgccgacgcatcgaccatcttctacaaccctgccggcctgaccaaactcgacagcagccagatttccgtcaacgccaacatcgtgctgcccagcattcattatgaggcggattccgccaccgactttaccgggcttcccgtccaaggttcgaaaagcggcaaaatcaccaaaaccacggtcgcgccccacatctacggcgcatacaaagtcaacgacaatctgaccgtgggcttgggcgtgtacgtccccttcggctctgccaccgaatacgaaaaagattccgtgttgcgccacaacatcaacaaactcggtctgaccagcatcgccgtcgaacctgtcgccgcgtggaaactcaacgaccgccattccttcggcgcaggcatcatcgcccaacatacttccgccgaactgcgcaaatatgccgactgggggattaagagtaaagcagagatattgacggcaaaaccgcccaaacctaacggtgtagccgaagctgcaaaaattcaggccgacggacacgccgatgtcaaaggcagcgattggggcttcggctaccaactggcgtggatgtgggacatcaacgaccgtgcgcgcgtgggcgtgaactaccgttccaaagtctcgcacacgctcaaaggcgatgccgaatgggcggcagacggcgcggcggcgaaagcaatgtggagtacgatgcttgcagcaaacggctacacggcgaatgaaaaagcccgcgttaaaatcgttacgcctgagtctttgtccgtacacggtatgtacaaagtgtccgataaagccgacctgttcggcgacgtaacttggacgcgccacagccgcttcgataaggcggaactggtttttgaaaaagaaaaaaccgtcgtcaaaggcaaatccgaccgcaccaccatcacccccaactggcgcaacacctacaaagtcggcttcggcggttcttatcaaatcagcgaaccgctgcaactgcgcgccggcatcgcttttgacaaatcgcccgtccgcaacgccgactaccgcatgaacagcctacccgacggcaaccgcatctggttctccgccggtatgaaataccatatcggtaaaaaccacgtcgtcgatgccgcctacacccacatccacatcaacgacaccagctaccgcacggcgaaggcaagcggcaacgatgtggacagcaaaggcgcgtcttccgcacgtttcaaaaaccacgccgacatcatcggtctgcaatacacctacaaattcaaataaacggcccgccgtttgaatgtaacaatgccgtctgaaacagatttccgtttcagacggcattgttttaggctcgatttatagtggattaacaaaaatcaggacaaggcaacgaagccgcagacagtacagatagtacggaaccgattcacttggtgcttcagcaccttagagaatcgttctctttgagctaaggcgagacaacgccgtaccggtttttgttaatccactatatttggaaggagcgtaacccttccgaatcaggacggcacatagggcgacgttttttgtatcgtcctgtgtgttgaaacatcagcataggcaacacaggaaaagccggctgttttgcgcctgcgtaccgtattggtcaaaatgccgtctgaaaccgataacagggtttcagacggcatttccgtcaattttctctttatctgccgaacaggttggcgatattttccatctgttcttcggtaaaaccgttttcgcccaatctgacggcaactgcccattcgcccgacaaaccgtgttccgcaccgagctgccgccatttttcgactttggcttcgtctgtggttttttcgggcagcggtttgacgggaatcctgctttttgggacggtattcatcggtttgcccctaatcgatggaatagccgcgaagatactgtatccgttcgcgcgtcatccgcgtgtcgcattgcagcttgaggtattcggcgtattcctgccggtctgcctgcgcggcggcttgtcggcagttgctgattttttcctgcgcccacttgcgttgttcgccgaccaactctttttgcacgtcggtatcgagtcctccccaaagtttggtaatttcggattccgcacgctggttttgtacgcgcgcctcttccacttcgccccgtgatacggtaacggtatcggcacgctcgccgtcgtcaggatgcaggatttccggttcgggcgcgccttctgcggcttggggtacgcccgcatcgccgccggcggcattgtgttccaaaatgtcttcgggcgtgggtttggacggttcttcttcacgggcttttccgctcaaaatcctgaccgcgtcttcttttttcaccgccttgccgtctatcatcacgatgctcttcacgccgtaaggcagcagcgcggcagacagcgtttgcgccgccataccgaccgtgttgtcgacaaatgccgtctgaccgtctttgacgggcaggaagcggacggctgccgtcaatacgccgtctttaaactcgacattgccgcccgtcttctgccgcacaatatccgacaaagcagtttccccgtacaacagggggctgtttgccttggcatcggcaagcgtttcagacggcacggtaatgttcaaatcggcgatacagaacgtgcgcccgccttcctgcgtttccgaagcgtgttccaaagaaaacgccaaaccgtaggcggcggcgataattttgtcggcatcgacaaactgcctgccgtcttcgcgcgcgaaagaacgcgcttcctgcgtgagcgtttcctgaatattgccgcgtatgccttgcaacacggcggggttggcgcattccaatgccttgggcggttcttccctgccgcaagcggcaagcagcagggcaaacggcagcgcaatgagtttccgatacatgatgttccttccaaacggtgcagaccgatagcggctatcatagcaaaagcacctgcaggcggtaaaccttgcaggtgctttgtcggaaaggcggaaaatcagcctttaaagaaattcacaaaaccggtgagaatcgcggcattaatcaaatcgacgaagaacgcgccgaccataggcacaatcaaaaacgccttatgcgacgcgccgaaagtatgcgtgacggactgcatatttgccaccgccgtcggcgttgcacccaagccgaaaccgcaatggccggcagccaatactgccgcatcatagtcgcgccccataaagacataggtaacaaaagtcgcgtacaaaaccatcaccacggtttgtacggcaagaatcacggttacaggccccgccaaaccggtcagctcccacagtttcaaattcagcaacgccattgccaagaaaagcgaaagcgaagcattgccgaacacatcgatggcgcggtcgaacatattgaccttgaatgcggcagtgaggatgttgcggatgaccacgccgccaaacagacaccacacgaatttgggcaggtcgaacagatattctttgtcgaagccgtccataatctcggcaaacgccaaacacgcggcaaacatggcaagcgtttcaacggcagattccgccgtaatcaggcgggtgcgttttgcctgctcgaacacgtcgtccgcgttgtcgtcctgatcctgttttttgttttcaaccggtttgcggcccattttgttgatcaggcggcgcgcaaccggcccgccgatcaggccgccgaacaccagcccgaaagtagccgatgcaatacccaaaccggttgcgccgaccaagccgtattgcgtttcaaaattaggtccccacgcacctgacgtaccgtgtccgcccgtcagcgacaccgaaccggtaatcagaccgatgagcggatccaaacccaaagccgtagccagtccgaccccgacaaagttttgcaccaagataaatccgcccacaatcgcggtaaaaaccaccagcggcaaaccgcccgccttcaaacgggaaaaatccgcgctcaagccgatggacgtgaaaaaaatcagcataaacgcattttgcagcggtttctcaaatttgaagctcacgccgtacgcctcgtgcagggcgaacaggacgatagcggcaatcaaaccgccggctaccggctcgggaatattgaagtctcgtaagaatttgattttttgaaccagaaatttaccaaccagcaacacgagcgtggcggcaatcagtgtgtaataactgttgaattcccattccatgttgtttcacctcctagaaatatttttccgagcatccgtttttgttccggatgtagtgtgtttcaacgcttggcgttatccgccgagtgtcatggtattgatgcgcggacaaggtgttttcagaaagaaatgaaaacaatggcgtgtccgtgaaaaataactggcaaatattaggggaatagttaaagattgtcaaaaaatgcgagtgtaaatcttttcagacggccttttgtccgatggcatggtgtgcttcgcgtcgccattgttctaatagggatattaatgattcggccgaagtgtggccgttgccgatggcggcctgcagccagtagcaggcggtcggaacatgacagccgacaccttgcccgtgatagtaaaaacaggcgaggtggtattgggcggaagggtggttttgttcggcagcaatggcgtaccagtgtgcagccgcccgaggatcttgcgccgtaccgaggccgtaatggtagatgcggcctaaggctgccgctgcgtttttatggtggaacccggcagcttccatgtaattttttcgcgcggcattgtagtcggcgggacggccgatggcgcaggcttgtgcttccgccaaacggtagatggtttcggtttgttgttgttgcaggcggcagttttgatttgttcgtattgttgcggatggtacagcgcggcgtcgctgatgagtttttgtgctgcggcggcagaacccagcgcggcggcacggtggtagtaatcttgcgcgatatggttgtcggctttgataccgagaccgtagcggtagaggtcgcccatgattttcagggcttcaggatggtttttctcggcagcggctttggcatatcgtgccgcttggaacggatcgcgttcggaaagttcgccggtcagggcgtattgggccagcttagactgtgcttccgcttgttccttatcggcggcacgacgataccattccaaggcttcaggtttgcgttgggcggcaagaaggtcagccagcagcgtttgtgcggcgatgtggccggcttgtgcggctggttcgagatagtgttcggcttgtgcgtggttggggctgacacctgtaccgtagaagtagatttgaccaagttgccagcaggcggcagttacgccgagtgctgccgctttttcgtattgttcgatggctgtttcaacgtcgccttggcgttgatgatggcgtgccagatggtaatacgcaggtgcggcatatcgggcggcagcaagttccgcccagtagagcgattgtggatcgttgcgttgcgcgtggtaacgcatgaggattaattgggcttctgagtgcccctgctcacccagccaggcatagtcgttgagaagctgtccggtcggggtgccgttgtgttcgcgttgttgcagcagggagaagagtgctttgggatggcgttgggccgcggcggcttccaaccatgaaagtgcctgctccggttggccgttttgcagcagatggttgcccaatacgaaagcagcttccgcataaccttgctctgccgcctgttgcaacaggggcagggcttgggcggtattggattgttccaaaagggcggcggcttgccggtagaggatatcaggagcggcggtcatggtttgcgggcggatataaagtggaagacggatgctgcggcatatgggcggcgataccggttgagggctttgtaaaaattttgctcggcatagttttatagagtgtattgccttgccggcttatctttaggatgtttggcttgttatattgttttgcctagggatatatccatattttgtgtgttacaaagggctcaggttgagtcggtatgcgctcatggcagctcggtcattatactgtttttgtaatttattgttaatgataaatgcagatttttgtgttttatttacatggcagtagctaaggtattgattgtttcaggccgtctgaaatgttttcagacggcctgaacttccttcgctaagtcagattactggtgtggaagagttggaggtttttttgttggggaaaaacacctgactgtagaagttgccgttaatttgggtcacgttgaggtggtacattcggtaggcatggaacagctctttgtcaggcggtgtcggatgattccaaaattctgccaaggtattttggtcagtaatgccgggaatatcataataggcacggccgagaaccttaactggcatattgtgaatcagtccggacaggccgctggtgctgttgatggtgaccatgccgagaccgtggcgcaggaaaacgggcagggggacatcatggacataaatcacacggcctttgagttcggggtgttctttgataaagcgtttaatgtcgcgccagtagtcgataaaaccgcggtccatcggatgatgcttgatgatgatgttggtatcggcaggcgcgtgctcggcaaatgaactcaaaacatggagcaggaagctgcggacgctgggaaagtcgcaatggatacggacttggctgtcgttgaatacctgtaagggaacaataaaaaacttgccgtatttgcctgcttccacacgtttggcgatttggatgtcttcaatatagtagttcaaacgcttgaggatggagagcgaccacggtttgaggtaatggccggcattgggtgcgcggtggtggatgtagtcggggtatttgcgtggattgcggaacaactcgatatagtaacggatagcgttttttgccatgggcgtaaaaccgccgtgtaccggcgttggcgctttatattcttgctgggcaagcttagggaattgttcaagaaaaaagtcggcacggcgcggcaacggggaaaatgcgttgacgccgtctttttctaaggtgatgtagtaggggcggaaatagccttcttcaaacgcccagaaactggcttggttttcgtttgcaatgcgttttgcaatgacgtgataagggcgtgtgtcgccaaagcagacaacggcctggatgtgatgttgagtgatgtattcttgcaaaaactcaggaaaggcatcgtagttgtcgttaaaaacaacggtatgcgcttgagtgggcggataaaaatagtcgtcgcctgcattaaagttgaatttatgtacggttttgccgtttgcagtcagccagtcggcaaggcgcagaaaaaaatcgccgacagggccttgaagcagcaggatattttctgcgctttcaagcaggttttgcaggttatttttgaggacggtctgtttcatgttgcaatgtggttttgttttttatgtaatagttttaggttgaactttcaagcatacgccaagagaattaacgatgcaaaggcaatgatgccgcaatagaggcaagtttatgacgcatcgttaactttgatggtatttatttgaaagatcgatatagttgtttgattttacctaattttttggcaaagcacccgcgatgtaatccgttgttgtttttttgcatatttttttgtcgtatcaggatttgggctgcggtttctgcatttatggcctgatgggtttcggggtggatgtagtcgggatagtggatgagcgtgccggcaatcagctgccaaagctcaagtctgcggctacggcgcgggatggggagcagatcttgggtaagcccccagcctgcgtaaaaaggcaggccgtagcagctgacttttttgccgcgcaacaaggcttcaaaaccggtcagcgaagtcatggtatgtatttcgtctgcgtattggagacaggtcaggatgtcggcttgttcggcggtttggtcggcatatcgtgcagcatcttcaggggaaatatggccgatgcggttaccgctgactacatcgggatgcggtttgtagatgatataggcattggggtttcgttcgcgtacggtacggagcaaatccagattgcggtagatttggggcgaaccgtagcggatagacgcatcatcttcaacctggccgggaacgaggatcacggttttgtcggttgacggggcggtgaagtctgagctgccgacgttgtatttactgatgtggttttcggtcagcattttttgcagcttcaaggccgtctgaaagtcttgatcgtcgaagttttggttttgtaggatgtattcaagacgggacggggtttcggcattgaaataaatgctcatatcgtcggtaacgagcgacagcggcggcactaagttggagccgagtccgaccgagcggataaagccgtcttccatgcgcagcagggggatgtggtgttgttcggcaaagcggacgatggcctctttgccgttgccccaagccaggatgcgtgcatcgtcggacagtttgacccttgccagtttttgggtggaagagataaatttcagacggcaagagggtacgttaaagaacggtttggcaaccgcgcgtttccacaaagacataccgacgcaatataactcgccacgcaatttgtcgtttttacgtttgaccgtcgccagatagtcgatgacatcaaagaggctgcctgcttcgccggtattggggttgaggtagcggctgtattgcagataggctgcggcgaagagctgcagcaagttgcgggtggcgcggcgttgggtttgaacaaggcggttgatttcaggatggcggtcgtcgcttacaccccatccggcataccacggcaggccgaaagtggtcagcggtttgccgcacaaaagcgcctcaaaacccatttgcgaggtaacgcaataaactttatcaacgttttgcaacaaagaaatcggattgatgtcttctgccaaaagatggacgcggtgttgctgcgccagttgggtcagatagccttgttttttgccgcacaaaacatcgggatgggtttttacccagatatcggcttgcgggttttcatttaaggccgtctgaaacatcagttcaaacgtagaggcgtctgcgccgccatattggatggccatatcgccgaaggtttggtcgatgatgaggacggtttcgggtttggatggggaacgtaaaggatggtcgtctgaaagttcgggcgcgtggttgtatttggacaggtggtgttgcaggatgaaatccatcgcctgctgcgcctgagccaaggtttcagacggcatggtatcggcggcaagaatcagttgttccaaacgcgaaggacgtgtggtgtcgtagtagatgccgatgtcgtcatagacgatagagtagggcggataaccggcgacacccagtccgagcgatcgtaaaaagccgtcttccaaagcaataaagggaagctggtgttcagcggcaaaagcacgcgctttgtgtgtcgtcgggcgcaaaccccagccgacaacagcctctgcttctttcccgtctttgcagatatgaaattcaggcaatagggtggagagatgggggattttgcggatgccgcgagaggggatgtaggcgtttttcacaatgcgttttcgtcgattattgttattaatggattgtaggccgtctgaaaagaggaacattctttcagacggcctgaattatttttaaaacgttaccgcttcagacaatactttgcctgccaagtctttaggcgacaggttcggctcgccttgcaacggccagtcgatgccgacggtcggatcattccaaatcagcgagtgttcggctttggggttgtaatagtctgtgcatttatagacgaactcggcttcatcgctcagtacatagaagccgtgtgcgaaaccttcgggtacccacagttggcgtttgttttctgcggacagaatttcgcctacccatttgccgaaagtgggggagtctttacgcatatcgacggccacgtcgaatacttcgccgacaaccacgcgtacgagtttgccttgtgtgttttcagtttgatagtgcaggccgcgcaatacgcctttgccggatttggagtggttttcctgcacgaaggtgcgttcgcagacttgggttttaaaccactcgtcgcggaaggtttccataaaaaagccgcgcgcgtcgccgaagacttggggctcaagcagttttacgtcaggaatggcggtatcaatgatgttcatctttttatctttcatctaaaggccgtctgaaaagtttcagacggcctcaaacattattttttcaacaggcgcagcaaatattggccgtattggtttttcgccatcgggcgcgccaattcttccagtttttcatcggaaagccaaccgttgcgccaagcgatttcttcgaggcaggcgatgtgcaggttttggatattttgcacggtttggacgaatgaagcggcttcgtgcaggctctcgtgggtgccggtgtccagccacgcgaaaccgcgtcccaatatttgaacggagagcgagccgtcttccaaatacatccggttgaggtcggtaatttccaattcgccgcgtgcggacggtttgagctgtttggcgaactcgacggcgcggttgtcgtagaaatacaagccggttaccgcccaatcggatttgggccgttgcggtttttcttcgatggaaacggcgcggaagttttcgttaaattcaaccacgccgaaacgttcggggtttttgacctgataagcaaacacggttgcgccgtgcgtttgcgctgccgcctgtttcaatgtttgcgtaaacgactgaccgtaaaaaatattgtcgcccaaaaccaagcaaacattgtcgttgccgataaattcttcgccgatgataaatgcctgtgccaagccgtccggactgggttgcacggcataactgatggaaatgccgaaatcgctgccgtcgccaagcaggcgtttgaaagaggcgttgtcttcaggcgcggtaatcaccaaaatatcgcggattcccgccagcatcaaaaccgacaaggggtaataaatcatcggtttgtcgtacacgggcaggagctgtttggatacgccgcgcgtgatggggtagaggcgcgtgccgctgccgcctgccagtatgatgcctttcatcttttctttcttcctttgcgatgggttttcagacggcattgcgtcgggatgccgtctgaaaactattttccagtacctaaacgttccaaacgatagctgccgttcaatacattttgccaccaggttttgttgtccagataccattgcacggttttgcggaggccggactcgaaggtttccaaaggcagccagcccaaatcccgcctgattttggctgcgtcgacggcgtagcgtacgtcatggccggggcggtcttgtacgaaagtaatcaaatcttcataacgcgccacaccggccggtttttcgggagcgagttcttccagcagggcgcagatggttttgacgacttcaatattggctttttcattgtggccgccgatattgtaggtttcgccgacaacaccttcggtaacaacctgatacagtgcgcgcgcgtggtcttcgacaaacagccagtcgcggatttgcataccgtcgccgtacacaggcagcggtttgccgtcaagcgcgttcagaatcatcaaaggaatgagtttttccggaaaatggtaaggaccgtagttgttggagcagttggttacaatggtcggcaagccgtaagtacgcaaccacgcgcggacgaggtggtcgctggacgctttagaggcagagtaggggctggacggcgcgtagggcgcggtttcggtaaacaaatcgtccgtgccgcctaaatcgccatagacttcatcggtggaaatatggtggaaacggaaggcttcgtgctgttcagacggcatttgttgccagtaggcgcgggctgcttcaagcagattgaatgtgccgacgatattggtttggataaactcgcctgccgaaccgatagagcggtcgacatggctttccgccgccaagtgcatcacggcatcaggccggtattgcgcgaatacgcggtcgagttcggcgcggtcgcaaatatccacttgttcaaaagcatagcgaggattatcggctacctcagtcaaagattccaaattgccggcataagtcagcttatcgacattgacgacagcgtcccgggtgtttcggataatatgacggacaacggcagaaccgataaagcccgcgccgccggtaacaaggatttttctcataaatttcagaggatagccaaaaaatataaacagattatagcagacagaatgtgtgtttttcagataaagaggccgtctgaaaacatctctttcagacggcctgtatcaggtcaacttaatcgtcgtagccattcggattattactcacccagcgccatgagtcttccatcatttgggttaaatcacgctgggtttgccagccgatttgcgcctttgtataggaagggtcggcatagaagcacgccaaatcaccggcacggcgcggtttgacttcatacggaatcgtcaaacccgaagctgcttcaaatgcgcggatgatttccaacaccgaagaagcgcggccggagcctaagttcagcaaatgcgtgcctgctacattactttttgcctgcatagccgcgacatggccttctgccaaatccatcacatgaatatagtcacgcatccccgtgccgtcgggggtagggtagtcatcgccaaataccgccaattgcggcagtttgcctgccgccacttggcagatataaggcaacaaattattcgggatgccgtttggctgctcgccaatcaagccgctttcatgcgcgccaatcggattgaaataacgcaacaaaatcatgctccagcgcggatcggctttttggatgtcggttaacatccgttccaccatcgctttggacgcaccataaggattagcggtatcgcctgggcgcatatcttccgtatagggcattttacgtatcatggcgcgacgcattaaagtaaacgccaaagcgcgtttatactggttatccagtttccctatatttttacgttacaaatcaagttgttggtattcatcgtgaaaatagaatttttcggcataacgctgactcataaaaccggcatgcgggctgcctgaaaaaatcattgcgacatcatcgtcatttaatgtttcatggttgttttctattaatgctaaagcaatttggtaattaattgccaaaatatcgttagtaatcacacgatagccgcgttttttggcttcgtaggcaaaggaacagcctccactaaatacatctgcaactgtatctacatcagacggaagctggtcacaaatccaggaagctattttctctttattaccgatatagttaattttcggatattgcttattcattttcactcatttttaaaatactttcagcaatagcttttgccaataaaggcggtacggcgttaccaacctgctgctgctgggcaattttgctgccgcaaaaaataaaattatcagggaaagattgtaaggcagctaattcacgaacggttaacgcccgattctgttcatagtgaaaaactttgcgcatatctcctgtaatacaaacggctggttttgttgctgttgtaacggatgtatttacggatatcacctgttttcggacgtaatggttcaggaatatcgttacggttacctccatttttaacaaatgccattttttctaacatttgtgccgaatgattcatagcttcatgatttgcaacgtgtggattgctttcgccagcagccagttttggaaaatgtcctattgctgatccaacagtctgatgggaaatctgcaaaggttcgggaaaggaaattttgcctttatccctcctcccgataaatatcactcggctacgtatctgaggaacaccgaaatcggctgcactcagtatcttacattccaccgaataaccgatattctgaaatgcttgaataatctcaatacgtgttttacctgaattgtgtgtatagagtcgcgctacattttccataacaaaaaaatatggttggacaattttaactattcggacaaactctttaaataaatggttgcgtgggtcatctgtaaatgtccgtccaatctttcctgccatactaaaaccttgacaaggtggtcctccaataatcaaatcaactgcttgtccgttaagacaattgattaaatcttgttcggttagtgtggttaaatctttttgcagtaattgatgatgggggaagttggtacggtaagtctgacaataatcagactccatttcaacagaaagcaattgttggaatccggcttgttcaaaacccaaggataggcctcctgctcctgagaaaaggtcaatataggtaagtggtgtgtgcataagtcaaaatccataaactcttcgattattttaccgcttcagcttcgcaaacgcatccgccatcgccgaattggctggggcgcggtcgttgcgttggggtttgcggccggctgtccgttcgcggctgcggttttcagacggcattttatgttttgcgccgcccggttcgtcatccaagcgcatggtcagcgcgatgcgtttgcgtgcagcatcgacttccagcactttcactttcaccacgtcgccagctttcaccacttcgcgcgggtcttggacgaacttgttggacagggcggagatgtgcaccaagccgtcctgatggacgccgatgtccacgaacgcgccgaagttggcgacgttggaaaccacgccttcgagtatcataccgacttgcaagtcgctgatttcgtggataccttcggcaaacgatgccgtctgaaactcgccgcgcggatcacggccgggtttttccagttcggacaggatgtccaaaatggtcggcaggccgaagcgttcgtcggtgaagtcggacgctttgatttgcttcacgcgctcgcggttgccgatgagttcggcggcgctaatgccttgttgcgccagcattttggcgacgacgggataggcttcggggtggacggcgctcgcgtccaacggctctttaccgccgttaatccgcaaaaagcctgccgcctgctcgaaggttttttcgcccaaacgcggtactttcagcaattttttgcggctgtcgaacgcgccgttttcatcgcggtaggcaacgatgttttgggcaagggtttgattcaagccggaaatccgcgccaagagcggggcggaggcggtattcacgtccacgccgacggcgttcacgcagtcttcgaccactgcgtccagcgatttggcgagctggttttggttcacatcgtgctgatactggcccacgccgatggatttagggtcgattttgaccaactcggcaagcgggtcttgcagcctgcgggcgatggacaccgcgccgcgcagggaaacgtccaagtcggggaactcgcgcgccgccagttcggacgcggaataaatcgacgcgccggcttcggacacgacgattttgtgcagccccatttccggcattccgcgcaccagttcgcccgcgattttgtcggtttcgcggctggcggtgccgttgccgatggcgatgagcttcacgccgtgttgcttaatcaggcgcgacagcgttgccaacatattgttttcttgatgcaaatagacgatgacggtatccagcagcttgccggtgtcgtccaccacggcgcatttcacgccgttgcggtagccggggtcgagacccagcgtggtcagccgtccggcgggcgcgacgagcagcaagtctttgagattgcgggcgaacacggtaatcgcgtcggtgtcggcggcttctttcagacggcctagggcttcaagttccaacgacaaaaagattttcgcgcgccaagtcagacgcacggtatcgcgcagccatttgtggccgtctgaaaccttgaagcggcaggcgatgatttgctcgtattcgctttgccgggtaatcggcgtgtcgtcgggctggtatttgagcgcgatgttcaacacgccttcgttgcggccgcgcaaaaccgccagcgcgcggtggctgggcatagtgcggacgggttcgcggtggtcgaaataatcgctgaatttttcgccttcggtttctttgccttcaacgacttgcgcgtggatttcggcttcgttccacagcttgtcgcgcagcgtgccgataagttccgcgtcttcggcaaactgctccatcagaatcgcacgcgcgccgtccaacgcggctttggcatcggggacgttttcgttcaggtagccttgtgcggcggcttccacgtcctgcgactgctcggcaagcaacacgtccgccagcggctgcaaaccgtgttcgcgcgcgatttgcgctttggtgcggcgtttgggtttgtagggcagatacaggtcttccagcgcggttttgttatcggcggcttcgatttgcgccctgaggtcgtctgaaagcttgccttgctcttcaatgctttttaaaacaacggctttgcgctcttccaactcgcgcagatattgcagccgctcggcaagccggcgcaactgcgtatcgtccaacccgcccgtcgcttccttgcggtagcgggcgataaacggcacggtcgcgccgtcgtccaaaagctcgacggcggcggtgatttgcgcggcagtcgcggagagttcttgggaaagaatttgagtaatgttcatcaatagaattccaacggacaggccgtctgaaatttcagacggcctgatttaaaaacaatcgctttaaggcagcgaattataatattcgtaggctttgtccatatcttcaaactggtacatatgccctttttccagcaccatcgcattatcgcaatattgcttcatggcgctgtggctgtgcgacaccaagatgatggaacggtctttgcgcttttcaaacaactcgtacttacatttatcggcaaaacgcgagtcaccaactgcaatcacttcgtcaatcaggtaacagtcaaactccaccgccaacgacagcgcaaaagccaaacgcgctttcatacctgaagaatagcgtttcaccggctcatacaaatattgccccagctccgaaaattcttccgtaaacgctttcacataatcgatatcgacattgtaaatccggcagatgaaacgcaaattgtccataccggtcagactgccttgaaacgcaccggagaatgccaaaggccaagaaatactcattgtccgcttgatttcacccgtggtcggcggctcaacgccactgatcaaacggatgagcgtcgatttacctgcaccgttgcggccgagaataccgattttctcgcccttctccattttgaagctaatatcgtgcaagactgtccgccaaccttggcgggtcagatagcgtttggaaacgtgttcaactgaaatcattgcggctcgactcctttactgaatttactgaccatcgccaagccaaacaacaacaacaccagattgcacaatacgatataccaaggattttcataggtaattacatcgctgccaaaatatccggcacggaacatttctgtgccatgcaccatcggaatcattaatgcatattcttgtaccttgggcggcaaattatgcacaaaaaagaacgcaccggataacggcatcatcacaaaagtcaatgtgccccaaatcttgccaaacggctcgaaattaaaggcaatcgaacaaatcaccaaacccaaaccaatcgcaaaaaaagccatcaaaagccaagccatcagcatataaaacatatctgccggcatttcaatccagccaatcgcaatcaataccgccataatcacaatctgcgcaatggttgcaccagcaatttccaaaatcatgcgcgccaagatggtatccaaaactcttacattgcggtgataaagcaagctggcatttgaagaaatcgacccaactgcccgttttgaggcattacgccacatcatcaacatcggatagccagtaatcgcaaatgcgacaatattcaaagttgaatatcggtctgcccttaaaaatttccacatcaagacgataacgaatgtcatcagcaacggctcaacaaacagccataaaaagccaatattattgcgaccgtaacgggtgataatttcccgcatcaacagcgcaccgattacgcgcctttgaatggctaaagattcccaaaatgatgttttatgcaaggctttcatcagtttttatgctcacgaatgctggcagtcaacaggctcaaaataccataaaccatcaagccgataatcagagtggcaacaatgttgtataaccgtttaggctcatgtgccaaatccggcaggctcggttgcgagatcacttccaaataaagctgctgacggtctgcttcaaccttggcactttccaaagaagtcatggcggctgccaactgctgctctgccaactggttttccaaatacacacgctgatattcggcagcctgattagacaacgaagaatgcccaccgcccgaaatggcacgtaactgttggtcaatttctttacgcaagctctgctcacgcgcctgcaaacccggaatctgcggattctccggagtgactgctttcacctgatccagctgggtttgaatcacaatcaattcatcttgcagcttggaaaccaaccccatttgcacttccgattgcgctttcaaatcaaaaacgccattggcaatccggtaatccgtcagattctgagaggcttcctttacccgctctgccgccgttttcactacttcttccgcatagcgcaccgtatcagcacgtgcacgatcgttcaactggttaatcaatgcttcaccttgttttaacaaagcctcattgattttcttagattccagcgcatcaaaggaagttacattcaacgtggaaatacccgaaaccgtatcaaaattgatcatcacctgatttttatagtattgataaaaagcctcttcctcgccacggaacccaaacccattaaagcggctgaacgcatcacctttggtttcataaaactcacgcaccggcaagattttacgcagttcatccaaagacgagcgcgaacgcatatactccccaaccgtgtaaatatcatcttgcgcacgggcaaaacctgtgccctgcaaaatggcacccaggccattgagagaagattggcttttaggcgagcgcaccacaaagctcgattgcgacgtaaaacgatcggaagcgaagaagccgaaatacaccaacgaaattaccgtagggataatcaccgttacccaaaataaagggcttagctttttaatccaacttttctttttcggctttttacgctcggctttggtttcagtggcaactgccacaggaagttgctcagacatcttaattactcacattaattagttaaattattaatactgttcgcgccactggtaaccggcgagaacacaaacgacaaaaatttctgcacttcagccaacggcgcattcgacacatacaatacatctttattcttcacaggaaagcgctgcatagaaaatagcgaatgcgcatcagccatattcacacgatataccgttggaatctctgcctcactgccataaccttgagcaatccatttatcctgacgttctgccggcaattccaccaatggcgtatagcggaacacaaacacaccacgcgcatcagaacggcgatcttgcaaaccgcccatacggccaatggcttcagaaagcgataagcctctggctgaaaaaccgatttcttgtgttctccccaccgcacccatagacgtaaaggtatagggattggtaatcatggtaaccacatcaccgcgacgcagcaaaatattttgtcgcggatttgcaactaaatcttccaaggcaacagttcgtactacattgccacgtgtcagctgcacattcgtatcctgcacatttgccgttgaaccacctaccgcagccaccgcatccaacacacgctcaccggctgccgtcagcggcatacgcacactattcccagcacgaatcaccgacacattcgccgcattattctgcaccaaacgcaccatcacttgtggctgattggccatttttttcaggcggcctttaataatttcctgaacctgaccaggcgttttaccgaccaccgaaatatcgccaacaaacggcacagaaaccgtaccacgtgccgtgaccaactgctctggcaacttagtttgatgcgcactacccgagcccatcgaagaaaggccaccaccaaacaatactgccggcggcgcttcccaaatcataatatccaatacatcaccaatatttagcgtaccagccgaagcataaccatcgccaaactgagtgaatgactgatttatctgagccttatataataactgagcaaccgtatgattcacatcaatcagctccacttcaggaatttgaacttcagattgttgccctaaagagacaattttttttgcgctggggcctgatgaaggaatcgcagagcatcctacaattaaacttccacacaataataatactgcgtgacgaatataaaatttcactttaaacacaagccaaatcctaatataattataaatggcctaattatagcacttaatcgaaataaatttatgagtacgtagagtataattagtattcttctttccaacttccttatacttatatacttatagattctaaaatcatgaaaagaattctttgcattacaggtaccagagccgacttcggcaagctaaaacctttattagcctatattgaaaatcacccagaccttgaattgcatttgattgtaactggtatgcatatgatgaaaacatatggcagaacctacaaggaagtaactcgagaaaactatcaacatacatatctgttttcaaatcaaatccaaggtgaaccaatgggtgccgttttaggcaataccattacgtttatctctcgtctatctgatgaaattgaacctgatatggtcatgattcacggcgaccgtttagaagcactagcaggcgcagctgtaggtgcattaagcagccgtttagtttgccatatcgaaggtggtgaactatctggtacagtagatgactccattcgtcattctattagtaaactttctcatatccacttggtagcaaatgaacaagctgtcactcgcctagtgcaaatgggagaaaaaagaaagcatattcacatcatcggctcccccgatttagatgttatggcctcttccaccctcccatccttagaagaagtcaaagaatattacggtttaccatacgaaaattatggtatttctatgtttcaccccgtgactacagaagcacatttaatgccacaatatgcggcccaatatttcaaagcattagaattaagtggccaaaatatcattagcatctaccctaataatgacactggcactgaaagtattctgcaagaattattaaaatatcaatctgataaatttattgcatttccttccattcgatttgaatattttttagtcttattgaaacatgctaaatttatggtcggcaactcaagtgcaggtattagagaagctcctctctacggtgtcccttcaattgatgttggtacacgccaaagtaaccgccatatgggaaaatctattattcatacagattatgaaactaaaaatatctttgatgcgattcaacaagcatgcagtttaggcaaatttgaagcagatgatacctttaatggcggagatactcgcaccagcacagaaagatttgctgaagtaatcaacaatcctgaaacgtggaatgtttctgctcaaaaacgttttatcgatttgaatctttaaattatggaaaaacaaaatattgcggttatacttgcgcgccaaaactccaaaggattgccattaaaaaatctccggaaaatgaatggcatatcattacttggtcatacaattaatgctgctatatcatcaaagtgttttgaccgcataattgtttcgactgatggcgggttaattgcagaagaagctaaaaatttcggtgtcgaagtcgtcctacgccctgcagagctggcctccgatacagccagctctatttcaggtgtaatacatgctttagaaacaattggcagtaattccggcacagtaaccctattacaaccaaccagtccattacgcacaggggctcatattcgtgaagctttttctctatttgatgagaaaataaaaggatccgttgtctctgcatgcccaatggagcatcatccactaaaaaccctgcttcaaatcaataatggcgaatatgcccccatgcgccatctaagcgatttggagcagcctcgccaacaattacctcaggcatttaggcctaatggtgcaatttacattaatgatactgcttcactaattgcaaataattgtttttttatcgccccaaccaaactttatattatgtctcatcaagactctatcgatattgatactgagcttgatttacaacaggcagaaaacattcttaatcacaaggaaagctaaatgcaaaacaacaacgaatttaaaattggtaatcgttcagtaggttacaaccacgaaccattgattatctgtgaaatcggcatcaatcatgaaggctctttaaaaacagcttttgaaatggttgatgctgcctataatgcaggcgctgaagttgttaaacatcaaacacacatcgttgaagacgaaatgtctgatgaggccaaacaagtcattccaggcaatgcagatgtctctatttatgaaattatggaacgttgcgccctgaatgaagaagatgagattaaattaaaagaatacgtagagagtaagggtatgatttttatcagtactcctttctctcgtgcagctgctttacgattacaacgtatggatattccagcatataaaatcggctctggcgaatgtaataactacccattaattaaactggtggcctcttttggtaagcctattattctctctaccggcatgaattctattgaaagcatcaaaaagtcggtagaaattattcgagaagcaggggtaccttatgctttgcttcactgtaccaacatctacccaaccccttacgaagatgttcgattgggtggtatgaacgatttatctgaagcctttccagacgcaatcattggcctgtctgaccataccttagataactatgcttgcttaggagcagtagctttaggcggttcgattttagagcgtcactttactgaccgcatggatcgcccaggtccggatattgtatgctctatgaatccggatacttttaaagagctcaagcaaggcgctcatgctttaaaattggcacgcggcggcaaaaaagacacgattatcgcgggagaaaagccaactaaagatttcgcctttgcatctgtcgtagcagataaagacattaaaaaaggagaactgttgtccggagataacctatgggttaaacgcccaggcaatggagacttcagcgtcaacgaatatgaaacattatttggtaaggtcgctgcttgcaatattcgcaaaggtgctcaaatcaaaaaaactgatattgaataatgcttattaacttagttactttattaacagaggattggctattacatatagctaattctcattaatttttaagagatacaataatgctaaagaaaataaaaaaagctctttttcagcctaaaaagttttttcaagattcaatgtggttgacaacatctccattttatcttacccccccacgtaacaatttatttgtcatatctaatttaggtcagcttaaccaagtccaaagcctaattaaaatacaaaaattaaccaataatttactagtaattttatatacttctaaaaacttaaaaatgcctaagttagttcatcaatcagctaacaagaatctatttgaatctatttatctatttgagcttcctagaagccctaataatataactcctaaaaaattactttatatttatagaagttacaaaaaaatccttaatattatacagcctgctcatctctatatgctgtcttttacaggccactactcctatctgattagtattgcaaaaaaaaagaatattacgactcatttaattgatgaagggactggaacatatgctcctttattagaatcattttcatatcatccaacaaaattagaacgttatttgattggaaataatcttaatattaaaggatatatagatcattttgacatattgcatgtcccctttcctgaatatgctaaaaaaatatttaatgcaaaaaaatataaccggttttttgcctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgattcacaaaaaataggtacacgaaaaacaagttaagggatgcagtttatgcatcccttaacttacttattaaataatttatagctattgaaaagagataagaattgttcaaagctaatattgtttaaatcgtcaattcctgcatgttttaaggaattgttaaattgattttttgtaaatattttcttgtattctttgttaacccatttcataacgaaataattatacttctgtttatctttgtgtgatattcttgatttttttctatttaatctgataagtgagctattcactttaggtttaggatgaaaatattctcttggaaccatacttaatatagaaatatcaacttctgccattaaaaataatgccaatgagcgttttgtatttaataatcttttagcaaacccgtattccacgattaaataaatctcatcagctatactatcaaaaacaattttgcgtattatatccgtacttatgttataaggtatattaccaaatattttataggattggtttttaggaaatttaaactgcaatatatccttgtttaaaacttggaaattatcgtgatcaacaagtttattttctgtagttttgcataatttatggtctatttcaatggcagttacgaaattacacctctgtactaattcaagggtaaaatgcccttttcctgagccgatttcaaagatattatcatgttcatttaatcttatatttgtcattattttatctatattatgttttgaagtaataaagttttgactgtgttttatatttttctcgttcattataaccctctttattttttcctccttataaaattagtataattatagcacgagctctgataaatatgaacatgatgagtgatcgttaaatttatactgcaatctgatgcgattattgaataaaagatatgagagatttatctagtttctttttttacaagaaaaaagaaagttcttaaaggttttatacttttggtcgtagagcacacggtttaacgacttaattacgaagtaaataagtctagtgtgttagactttaatgtttttttaaggcattagtgcatttaagcgtcagagcatggctttatgccgagaaaactattggttggaatggcgtgtgtgttagccaaagcttgatatcgaattcctgcagataaatattcttggtaatcatgttgcaatggcacaacctgctttaatagcttattaaactcatcagttgtaatcacctttttagtagcatagcaatcaagccaatccggatctgctatttttggggaagtgaaatctatttgatcaaaataaactaaaaccccactacctaaaaaatgctgatttgcataggatttagaaaagcctaagtctgcaacaacaccaacagggatacccttacattcagcttcaaaaagcatagtagatgaataagataaacaataccccatttcttggaaggcttgcgcggtactttttcgctctattgtcaaattactcggcaactgaaactgctttgccagctctatatacgaatgtttatcctgatgcacagtaatatctttatctgcaacccttagcaaaatagtaaattctttctcagggtatttttcagccaaggcaatcaatttttttaatgtataaattctttcttcttttttaaatgggattttaacttggtcaataaagtaaattttctctccatgacaacctttcgaagcatggcgaaaaattggataaccataaagtatattttgacaacttaatttatattgtttcttatattcctctgcaattctaaaatcatgcttattattatataaaacaatatcagcccccatacgagatagaatacttgcctgatcaccgaatactacacctggaaacaaggtaataatcaatggccttgaagcaatatttaattgcgcattctgcttaaagaacctttttaacaacccatttccaaccgataaaattactgcgtcataatattgatgcatattcttaataaagtaatcatcaatatgaaaaaaaaaattgcttggtctttatctatccctgattctaataactgtcgatttgaaagaatgttttctcgacttttgtggatataaatatcaatttgagcatcttttatctcttttgcaacagcatagcccgagttaaggaacgagtcataactggcaattagtaatacttttttcactattttcccttaattctacaccatatgaataaaattatagtattttaccttagatatcaaatatacttaaccaaaaaaatctgaagaaatctactgctacttcagggataattatttcattaagattttacaaccattattatcaatctatcaaagtatttttagtattttattctatgaaaaaaattctcgttaccggcggcaccggttttatcggctcgcataccgttgtttctttgctgaaaagcggccatcaagtcgtgattttggataacctatgcaattccagcatcaatatcctgccacgcttgaaaacgattaccggccaagagattccgttttatcaaggcgatatccgcgatcgtgagattttgcgccgtatttttgcggaaaaccgcattgattcggtgattcattttgccggcttgaaagcggtgggtgaaagtgtggccgagccgatgaaatattatgataataatgtttccggcagcttggtgttggcggaagaaatggcgcgtgcgggcgtgtttagcattgtgttcagttcttcggcgacggtttatggcgatccgggcaaagtgccttataccgaggatatgccaccgggcgacaccaccagcccttacggcgcatcgaaatcgatggttgagcgcattctcactgacattcaaaaagccgatccgcgctggagcatgattttgttgcgttatttcaatccgattggcgcgcatgaaagcggcttgattggcgagcagccaaacggcatcccgaataatttgttgccttatatctgccaagtggcggcaggcaaactgccgcaattggcggtatttggcgatgactaccctacccccgacggcacggggatgcgtgactatattcatgtgatggatttggcagaaggccatgtcgcggctatgcaggcaaaaagtaatgtagcaggcacgcatttgctgaacttaggctccggccgcgcttcttcggtgttggaaatcatccgcgcatttgaagcagcttcgggtttgacgattccgtatgaagtcaaaccgcgccgtgccggtgatttggcgtgcttctatgccgacccttcctatacaaaggcgcaaatcggctggcaaacccagcgtgatttaacccaaatgatggaagactcatggcgctgggtgagtaataatccgaatggctacgacgattaagttgacctgatacaggccgtctgaaagagatgttttcagacggcctctttatctgaaaaacacacattctgtctgctataatctgtttatattttttggctatcctctgaaatttatgagaaaaatccttgttaccggcggcgcgggctttatcggttctgccgttgtccgtcatattatccgaaacacccgggacgctgtcgtcaatgtcgataagctgacttatgccggcaatttggaatctttgactgaggtagccgataatcctcgctatgcttttgaacaagtggatatttgcgaccgcgccgaactcgaccgcgtattcgcgcaataccggcctgatgccgtgatgcacttggcggcggaaagccatgtcgaccgctctatcggttcggcaggcgagtttatccaaaccaatatcgtcggcacattcaatctgcttgaagcagcccgcgcctactggcaacaaatgccgtctgaacagcacgaagccttccgtttccaccatatttccaccgatgaagtctatggcgatttaggcggcacggacgatttgtttaccgaaaccgcgccctacgcgccgtccagcccctactctgcctctaaagcgtccagcgaccacctcgtccgcgcgtggttgcgtacttacggcttgccgaccattgtaaccaactgctccaacaactacggtccttaccattttccggaaaaactcattcctttgatgattctgaacgcgcttgacggcaaaccgctgcctgtgtacggcgacggtatgcaaatccgcgactggctgtttgtcgaagaccacgcgcgcgcactgtatcaggttgttaccgaaggtgttgtcggcgaaacctacaatatcggcggccacaatgaaaaagccaatattgaagtcgtcaaaaccatctgcgccctgctggaagaactcgctcccgaaaaaccggccggtgtggcgcgttatgaagatttgattactttcgtacaagaccgccccggccatgacgtacgctacgccgtcgacgcagccaaaatcaggcgggatttgggctggctgcctttggaaaccttcgagtccggcctccgcaaaaccgtgcaatggtatctggacaacaaaacctggtggcaaaatgtattgaacggcagctatcgtttggaacgtttaggtactggaaaatagttttcagacggcatcccgacgcaatgccgtctgaaaacccatcgcaaaggaagaaagaaaagatgaaaggcatcatactggcaggcggcagcggcacgcgcctctaccccatcacgcgcggcgtatccaaacagctcctgcccgtgtacgacaaaccgatgatttattaccccttgtcggttttgatgctggcgggaatccgcgatattttggtgattaccgcgcctgaagacaacgcctctttcaaacgcctgcttggcgacggcagcgatttcggcatttccatcagttatgccgtgcaacccagtccggacggcttggcacaggcatttatcatcggcgaagaatttatcggcaacgacaatgtttgcttggttttgggcgacaatattttttacggtcagtcgtttacgcaaacattgaaacaggcggcagcgcaaacgcacggcgcaaccgtgtttgcttatcaggtcaaaaaccccgaacgtttcggcgtggttgaatttaacgaaaacttccgcgccgtttccatcgaagaaaaaccgcaacggcccaaatccgattgggcggtaaccggcttgtatttctacgacaaccgcgccgtcgagttcgccaaacagctcaaaccgtccgcacgcggcgaattggaaattaccgacctcaaccggatgtatttggaagacggctcgctctccgttcaaatattgggacgcggtttcgcgtggctggacaccggcacccacgagagcctgcacgaagccgcttcattcgtccaaaccgtgcaaaatatccaaaacctgcacatcgcctgcctcgaagaaatcgcttggcgcaacggttggctttccgatgaaaaactggaagaattggcgcgcccgatggcgaaaaaccaatacggccaatatttgctgcgcctgttgaaaaaataatgtttgaggccgtctgaaacttttcagacggcctttagatgaaagataaaaagatgaacatcattgataccgccattcctgacgtaaaactgcttgagccccaagtcttcggcgacgcgcgcggcttttttatggaaaccttccgcgacgagtggtttaaaacccaagtctgcgaacgcaccttcgtgcaggaaaaccactccaaatccggcaaaggcgtattgcgcggcctgcactatcaaactgaaaacacacaaggcaaactcgtacgcgtggttgtcggcgaagtattcgacgtggccgtcgatatgcgtaaagactcccccactttcggcaaatgggtaggcgaaattctgtccgcagaaaacaaacgccaactgtgggtacccgaaggtttcgcacacggcttctatgtactgagcgatgaagccgagttcgtctataaatgcacggactattacaagcctgaagccgaacaggttttaatatggaacgacccgacagtcggcataggctggccgcttcaaaccgcgccgctgctgtcgcccaaagaccttgccggcaaaacgtgggcgcaagccgaaaagctccgccttccgctttaccgataaaaaatgccgtctgaacgtttcagacggcattttttccgacagcctacttgcccgccttcagtacgcgctgtgcaaagaaaaacatcccggtaacgaagaacgccaaacccagccaagaagcggcggcatcccagttttgcagattcaacgcgagcggcgcatccgagccgccgttggtcacggagaaggcaataataaacgccataatcacaccgatcaggctttcaccgacaatcaggccggcggagaacaaggttccgatgcgctcggcgtttttcagacggccttcgcggttttccgcttttttaccgatgatgtgtttcaacaccgccgccaacaccgcgcctgccacgatgggcatattgacggacggcggcagataaatacccataccgaccgcaaggacgggcagggcaagtttgccgcctgatgattttttcaacaccaaatcgacgacgattaatactgctccaatcacgataccggtaaagatatagacccattcaaggttgtgggcgaaaatgcccgacgcgatggtcgtcatcaaagtcgcttgaggggctgccaaagcctgcgccgcgtccatgccttcgcgcggcattgcgccggtaaagccgtaggcttcgtaaagcagttccaacacgggcgaaataaccagcgcaccaacgatacagccgataatcagggcgacttgctgccgccaaggcgtggctttgagcaggtagccggttttcaagtcttgcaggttgtcattggaaatcgaagccacgcagattactgccgagccgcaaaacaaagtcagtgccagcaaaaatttgcggttagcctcatccgccaacaaacctccggattcgcctaccagcagcaaaaccagtgaaataacgacgacggacacgatgcccacgccggaaatcgggctggaagacgagccgaccaaacctgccatataaccgcaggcggcggcgaccaaaaagccgatgacggaagccaaaagcgtgcaaacgaccaccaaaagccaagccatgccgcccgtaatgtgcgaatcgccgataaagtggtaaaacgacacgcctaaaacaaacatcatcgccagcacccaaaaaatcatagccttaggcgacaaatcctgttcggcgcgttccgcagcgggcgcaccgccgccaaaactcttgaacgacatcttcatgccttccaccatcggcttgagcagcatcaacagcgtccaaaccgccgcaatgccaatagtccccgcaccgataaaacgcactttctccttccacagcttcatcgcaaacgccgccatttccatatcggaaggttgcggaatgtgtgaggagaaatacggcacggcaatgccccaagcaatcgaaatgcccaacaggatggcgataccgcccgtcagtccgaccaaatagcccgcgcccaacaatgccagtgaaaagcccatcggcagctggaaaatcgccgtaccgcttttaaaccaataactcgcgctgtcggcaatcacgcgcagacctccggcgcaaaagctcatcaatcccgccaacgcaccgccggccgccagctctttgatgccgtgctgcctgacggttatccccttcttcatgaccgcccactttcaaaatttcagcagccgccacaccttccggataaggcaaatcgcttttcaccaccattgcgtaacgcagaggaatggtgaaaatcacccccaaaatcccgccggcaatacataaaagcgtcgtctgccagaacgggaaaccgctccagtagcccgccattcagcaaaccgggcaggacgaagatgatggtcgaaagcgtacccgca

SEQ ID NO: 37815 - DNA, 427 bp, Neisseria meningitidis
  misc_feature (1)..(427): N is any nucleotide
aatgancggcggcaggctggcgaccgcgtatccatactttccgtcatgattgaagacaatcccgacataccgcagctttgggcgcaatgttcgattttncctctatccggttccgtatcgaaaaaacaaggggctgtactagattagccctaaatcccacaccaatcccgcagattttaagctgttgagacggtgtgccgaagttaaatcgaaattcgcattctttcaagaacagcgggaaagatttacgatcgattccgttgtattttcgcaagacgcgtttagtctagagtctgtatattacattatttttagggtctgctagccaatttcttgttcccttcattattttatcttctgaaagaaaattatttttttccatgctattaatattaatgatatgattttnatttaaaataaatgtttn

SEQ ID NO: 37816 - DNA, 684 bp, Neisseria meningitidis
acaatttctcctgcagcgccgatgatgtttttaacgatatctgcagtgccgttgaaggcttcggcggcattgcccgatctgtccagctcggggctgtatcgggtggcgcgtttgaatccgtcgcctactccttgcgtcagcatactaccggcattgtggaaacggtcggcaagccgttgtccggtgctgcggttgtcggtcaggttgaggcggatattttgggcaacgccttttatgtcgtagctgtatatatccctcgcgcctttgggagcgggatagccgccgccctgtggcccgtcatagccgtcggcgggatggtgttcgtatccgtcccaatggatgcggtaaaggctaaatccgtcaacgggactaccggcttcatcagaatcggaatgtgaggcatggttgtcgaagggggaatggacttcgtgcccgtgatcggaaaagcggacaatgtagccgatatttcctttaatggccgcctgttgaatcatcaggttgcccaactgatggctttgtatttttcccaatccgatatgrccgactgcgctcggcaagttcccccctgctgccgaataggtggtatttcccgtcgggttcgaaatgctgacggtcgagaacctgccggataaaagaatcgtttgccaaatctgaggcgtgtgcatgcatcggcaggcacactgc

SEQ ID NO: 37817 - DNA, 28874 bp, Neisseria meningitidis
gcttgcatgcctgcaggtcgactctagaggatcccgaaacgccgtgaaatcggtcacggccgtttggctaaacgtgcattgttggccgtattgccgaaacctgaagatttcagctacaccatgcgcgtggtctccgaaattaccgaatccaacggctcttcctctatggcttccgtctgcggcggctgcctgagcctgctgtctgccggcgtgcctttgaaagcacacgttgccggtatcgcgatgggtctgattctggaaggcaacaaatttgccgtcctgaccgacattttgggcgacgaagaccacttgggcgatatggactttaaagtggccggtacgaccgaaggcgttaccgcgctgcaaatggacatcaaaatccaaggcattaccaaagaaattatgcaaatcgctttggcacaggccaaagaagcgcgtctgcacatcttggatcagatgaaagccgccgttgcgggcccgcaagagctgtccgcacacgcgccacgcttgttcacgatgaaaatcaaccaagacaaaatccgcgaagttatcggtaagggcggtgaaaccatccgttcgattaccgctgaaaccggtacggaaatcaatattgccgaagacggtacgattaccattgccgcaaccactcaagaagccggcgatgcggcgaaaaaacgcatcgagcagattactgccgaagtggaagtgggcaaagtgtacgaaggcactgtggtgaaaatcctcgataacaatgtcggcgcgattgtcagcgtgatgccgggcaaagacggtttggtacacatcagccaaatcgcccacgagcgcgtacgcaatgtcggcgactacctgcaagtcggtcaggtggtgaacgtgaaagcattggaagtggacgacagaggccgtgtccgtctgtccatcaaagccctgctggacgcgcctgcccgtgaggaaaatgccgccgagtaacgcttagggtgaaagtgccgtctgaacaggtttcagacggtattttttacgggtatcgggaatgaatggggcttacagccacaggacggcaagtttccataatgcccataatgatacggataatcccgtacacaggcggatatatcggttttgcatgatttttttcagttgcagggaaaaaatgccgattgctaaaagattgggcagcgtacccagtgcaaaggcaagcatatataacccgcccgttgccgcactaccgcttcccagcgcgtaaagcgacgcgctgtaaaccagtccgcacggcagccagccccataatattccgaccgcaaggcaggcgggtatggattttatgggtaacagccggttgagtatcgggttcaggttccgccatatcggtttgccgattttctcgatttttgccgccaaggaagaaataccgctcaagtataagcctaaaaagagcagcaggaggttggcggccgtgtataaaatattctgcaggacgcgggtttggtcgagtgaaacgccgacctgtccgattaatccgagtatcaggccgattgccgtatagctgcttacccgtcctgtgttaagcagcaggatcagccaaaagcggttgatatgcggggggagttggagcgcaaacgcgctgcttaatccgccgcacataccgatgcagtgcgttccgccgaagaaaccgagtaggaacagggtgaggaaagtgatgtcgtggttcataggcagtttgaagtcaaatatttttcgggaaaagggatgatttgcggcagtccggcacataggatccgccgagggcattgcccgtgctgttaaagtcttgaataaggatgcagtttgcaccctgtatttcgataattttgtaaaatccgccctttactgcgccgtcggcgggtttgccgtgtgcgtcaaaatacaggatggtgcggttttgaagatgcgcgcaatttgaaacggccgggtttgccggtatgtttcgggtgcaggcggcaaggattgcacaagggaaaagcaacagtaatatgcggaacatggtgtttcttgtaaggggtaacaaacagtataatggctgattttaatcctcaggcggcgggagatggaagcatttcccttcggtgcgggggatttcggattcggaagcaacagacgatacgggatttcggaacaatatgaacactttgaaatttaccaaaatgcacggtttgggcaacgattttatggtgattgacgcggtcagtcaggattttacccccgaggacgcgccgattgcggaatgggcggaccgcttccggggcgtgggcttcgaccagcttttggtggtcgggcgttcggaaaccgaaggcgtggatttccgttaccgtattttcaatgccgacggcagcgaggtcgggcaatgcggcaacggagcgcgttgttttgcccgttttgttgcagacaagggtttgaccgataagaaagaaatttgtgttgaaacggcaaatggcgttatttttccgaaattgtccgataacggtatggttacggtcaatatgggcaaaccgaagtttatgccgtctgaaataccgtttgtccccgaatcgggcgagggggatgatgcctgtatttacggggtgcatctcgaatccggcattcagcctgtcagctgcgtcaatatgggcaacccccatgcggtgattgtggtcgatgacgtggaatgcgcgccggtgcgcgaaaccggttcgcttatcgaaccgcacaggcagtttcccgaacgcgtcaatgtcggctttatgcaggttgtcggccgaaccgcgattcgtttgcgcgtgttcgagcgcggcgtgggcgaaacccaagcttgcggtacgggcgcgtgtgcggctgtggtggcgggtatccgtctggggctgttggatgaagggaaaacggtagaggtggttttgccgggcgggactttatatatcgaatgggcctgcggcggcgatgtgatgatgaccggccctgcggaagcggtgtttgaaggtgagttggcgtattcatgattttgctgcatttggattttttgtctgccttactgtatgcggcggtttttctgtttctgatattccgcgcaggaatgttgcaatggttttgggcgagtattatgctgtggctgggcatatcggttttgggggcaaagctgatgcccggcatatggggaatgacccgcgccgcgcccttgttcatcccccatttttacctgactttgggcagcatattttttttcatcgggcattggaaccggaaaacagatggaaacggatggcaggcagaccccgaacatccgctgctcgggctttttgccgtcagtaatgtatcgatgacgcttgcttttgtcggaatatgtgcgttggtgcattattgcttttcgggaacggttcaagtgtttgtgtttgcggcactgctcaaactttatgcgctgaagccggtttattggttcgtgttgcagtttgtgctgatggcggttgcctatgtccaccgctgcggtatagaccggcagccgccgtcaacgttcggcggctcgcagctgcgactcggcgggttgacggcagcgttgatgcaggtctcggtactggtgctgctgctttcagaaattggaagataatacggtgcggccgtatcggaacaaaaagttataaagaaagaaattttggatattggttttttaggcggcataggtttaggataaagccatatccgaaatttgtttatgtttcggcgcaaatcccctgcaatcggacaggatgcctatggggattgcgccttactgtcgaaaccttattattcaggagcagaagatgaaaattgcaaacagcattaccgaactaatcggcaacacgcctttggtcaaactgaaccgtctgaccgaaggtttgaaggcagaggttgccgtgaaactggaatttttcaatccgggcagcagcgtcaaagaccgcattgccgaagcaatgattgagggtgccgaaaaagcgggcaaaatcaacaaaaacaccgtcattgtcgaagcaaccagcggcaatacgggtgtcggtttggcaatggtatgtgccgcacgcggctacaagctggcgattaccatgccggaaagcatgagtaaggagcgcaaaatgctgttgcgcgcgtttggtgcggagctgattctgacccctgccgccgaagtatggcgggcgcgattgccaaagcgaaatccttggtggacgcgcatcccgacacttattttatgccgcgccagttcgacaatgaggcaaaccccgaagtccaccgcaaaacaaccgccgaggaaatttggcgggatacggacggcaaagtcgatgtcttcgttgccggcgtcggcacgggcggtacgattaccggcgtgggcgaagtgttgaaaaaatacaaacccgaagttaaagtggttgccgtcgagcctgaagcttcacccgtattgagcggcggcgaaaaaggcccgcacccgattcaaggcatcggcgcaggctttattccgaccgttttgaataccaaaatttacgacagcattaccaaagtgtcgaacgaagcggcttttgaaaccgcccgcgcaatagcggaaaaagaaggcattttggtgggtatttcttccggtgcggcggtttggagtgcgttgcagcttgccaaacagcctgaaaacgaaggcaagctgatagtcgtgctgctgccttcttatggcgaacgctatctctctacgccactttttgcagatttggcataatgctttaatcggattgtcgaaacattcagacgcatttttcggtatcggtgtaacgccgtgccggaaaatgcgtttttgcatatatgccgaaaacgccggttgtgttttaatcaggtgttggtgtcgccgcatcgcttgagggaaatattttttatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatattcgggttttatttggcaggacggttttttgccccaacggaaaatagcctgcctgcccgtaaaatcagccgtttgtccgggtgcagccggggctttgggcttcagacggcatattttcggaatggcggcattcttgccgtcggcgcggcagccgtatggggaagggaggggatattgtggtcggtaacggcaaaaaatatgccgcaccattgctggtgctgggttgcgtggtgttcggtctgggcagtctgattgtcagatccgtccccgtcggttcgtatgcaatcgcattttggcggttgctgatttcggtgttcgtattttggtttttagcacggtttttcaggcaaaaattcccaaaaaacaggaaaaccgtccgatatgccctgacggcgggcgtgtttctcgctttcgatttggcgttgtggcacgaaagcatacacgcggtcgggccgggtatttccaccctgctcaacagcctgcaaatctttttcttgtcggcaatcggtgttttctttttcggcgagcgtttgagcgggctgaaaaaggcaggcttaatatcggcagttgccggcgtggcgatgattgccggtgcggaattcggctacaacggtaatgcggtttggggattcgccagcggtttggtatcgggactgatgctcgccctgtcgatggtgtttgtccgcaaaacccatgaaatcgagccggtggcgcttttcccttcaatgatgattttgagtttgggcggcgcggtatcgctggttgttccggcattgctgatggatggcggcgcgctttatccgacgacttggaaagatgcgggtttggtgcttgtgtacggcgtggtgatgcagtgcttcgcgtgggcgatggttgcctatgcgattccgctgctttcgctgtcgctgacggggctgctgcttttgtccgaaccggttgccgccctgttcatcgattatttcgggttgggcaaaccgattgaaggcgtgcagtgggcaggggtggcgctgacgctttcggcaatttacctcggttcgctgaaacggcagtcttcacattgatttcatcagggcaatattggcagttcgccgtgcaaaacctgcgtatattggactgataggtaggaaaatccgacaacgttagactcgcctgtaaaagtgaggaatagcaaatgccgtctgaaactattttcagacggcattcttggcttcctggcctaacggattgccgtaccggacctgccgaaatcgccgaagttcatcaaaatgaacattgccttgccgacaaccagcttgtcatccacaaatccccagtagcgcgaatcggcactgttgtcgcggttgtcgcccatagcgaaatagcgtccttcgggaactttgcacacgaaaccgctgccgtcgtcggcatattggcagtgttccaaaccgctttgctctatggaatatccgttttcagacataatatcggaggtatatttgcccaatacgggcagggaaacggcaggctgtccttcttttttcagaatattgaaggatttgccgtctagaccgctgcggaacatatccgtgttgtggatttcggaagggtcggtgtcgtcgggataacggtatgtgccgtcaggaatgtcggaagtgggtttgccatttaccgtcaaaatcttatcccgatattcgaccacatcgcccggaatgccgacaatacgcttgatgtaggtcatctccggctgcagaggataattaaaaacaacgacatcgccccgttcgattttgcctgtaggaataaatatattgtttaaaacgggtacgcgcaggccgtaggaaaatttgccgaccaaaatgaaatcgcccttgatcaggcccgggcgcatcgagctggacgggatttggaacggttcggcgataaacgaccggatgaggaacaataccaaaacggtagggaagaaactgccgaaataatcgccgaagtggctgctttccgagatttcgggatgagtcttcaggcggtatttatataccccccaagccgtaccgcacaatacaacgaaaatcaggaaaacggcggtaaagctcataaacagggacaaagcggcaaacacgccgaccgctgtcaggatataggcgtattcaaggccggaactccattccccgttttcctgccgcttcttgtcgcttttgaaataaaggatgatgccggcaagcagcgcggcagccgcgcccgacattagcattgtgttcattgttgttccttaatgcttaaaaacccgcctgtccgtgcaaccgttttaaggcggcaaattgcaaaatttgtttgcgggcgcgtgcccctgaaatcagggcggtttgaggggtgttcccgacgcgccgccctgtgtgccggagttatttgtcgctcacctgcaaaatcgccaagaacgcgctttgcggaatttccacattgcccacttgtttcatacggcgtttacctgccttttgtttttcaagcagttttttcttacgcgtaatatcgccgccgtaacatttcgccaagacgtttttacgcagtgctttgacgttttcgcgggcgataatctggctgccgatggcggcttggacggcaatgtcgaacatttggcgcggaatcagctcgcgcattttcgatgctagctcgcggcctcggtgaaccgcgctttgacggtgcacaatcaggcttaaggcatcgactttttcgccgttgaccataatatccagcttaatcaaatcagacggttggaactctttgaaatgataatccaacgaagcatagccgcgcgaagtggatttgagtttgtcgaaaaagtccatcaccacttcgttcatgggcaaatcgtaagtcagcatcacttggcggcccatgtactgcatattgacctgcacgccgcgcttttggttacacaaagtcatgacgttgccgacgtattcctgcggcacaaggatggtcgcggtaataatcggctcgagtatggtttcgatgctgccgatgtcgggcagtttggacggattttcgacttcgattttttcgccgcttttcaacacgacttcataaatcaccgtcggcgcggtggtaatcaaatccatatcgaactcgcgctccaagcgttcctgcacgatttccaagtgcaacagacccaagaagccgcaacggaagccgaaacccaatgcttgggaaacctcaggctcaaatttcaacgaagcatcgttaagctgcaatttttccaaagcatcgcgcaaagcttcgtagtcgtggctttctacgggataaagtccggcgaatacctggctttgcacctcttggaaaccgggcagcggctcagtggcagggttggcaaccaaagtaaccgtatcgccgactttcgcctgtcccaattcttttacgccggtaatcaaaaagcccacttcgccggcttttagttcttgtttttgaactgatttcggtgtgaatacgcccagctgctcgacctgcgtttccgccttggtgctcataaagcgcactttgtctttcagtttgatggtgccgtttttcactcgaatcagcataaccacgccgacatagttgtcaaaccacgaatcgacgataaccgcttgcagcggcgcgttttcgtcgccggtcggtgcggggattttggcaacgatttcttccaaaacgtcttccacgccgatgccgcttttggcggaacattgcaccgcgccgacggcatcgatgccgatgatgtcttcgatttcctgttccacgcgttcggggtcggcggcgggcaggtcgattttgttcaaaaccggcacgacttccacgcccaaatcaatcgcggtgtagcagttcgccacggtttgcgcttccacgccttgcgacgcgtcaacgaccaaaagcgcgccttcgcaagccgacagcgaacgggaaacttcgtaagagaagtcgacgtgtcccggcgtgtcaatcaggttgagttgatacacctgcccgtcgcgtgctttatagttgagcgcggcggtttgcgctttgatggtaatgccgcgctctttttcgatgtccatggaatcgagcacctgcgtactcatttcgcgcaaatccaaaccgccgcagtattggatgaagcggtcggcaagcgtcgatttgccgtggtcgatgtgggcaatgatggagaaatttcggatatttttcattagagttgttttgaatgtcggacagtgggtttgggaaatgccgtctgaacaaacggcgttgcgtccgaatatcgggtgcaacgtggaaatagcccgttattctaacggaaaaccgctgttttggcataagtttgataaaggtcttataaagatttgacgatttctgccaccatttttgcggaatttgccgccgccgttttcaagaactcgtcaaagctgatgtctgctttttcatctgccgaatcggaaaccgcgcggatgatgacgaaaggcgtttccaactgatgacaggtttgggcgattgccgccgcttccatttccactgctttgacttcggggaagtgcttgcggatttccgccacgccttcgctgctgtggacaaagcggtcgccgctgacaatcagcccttgttctaccgccgcgccttcaaacgtccgcgccgcccgttttgccgcctcaatcaaaatgccgtctgaagcaaaccttgccggcagttgcggcacttgtccccaggcatagccgaatgcggttacgtcgacatcgtggtgtgcggtttccgtgccgatgactacgtcgccgactttcaaacccttgcccaaaccgcccgcgctgccggtgttgatgacgcagtccgctgcgaattcacggataatccaagccgttgcaaccgccgcgttgaccttgccgatgccgctcaatgcaagcaccatgcgttttcccgccaattcgccttcataggcggaaaatctgccgaaagagacggctttgacattttccatcatctcgcgcaaaagctcgatttcttgttccattgcgccgataacggctactgttttcaaagacatattgctgacctgttgtgaatttcggatagaatgcctgattatacacgctaacacggcaggattgagtggaggtggtttgtccgtgccgtctgaaacggtttcagacggcacggcgggtttttggtagaatgggaaggtacagattgtttgaagattaggggacgaggatgtttaccgatgaaaatatgaccgcaaaggaagaactgttcgcatggctgcgccatatgaaccaaaacaaaggttccgacctgttcgtgacaacccatttcccgcccgcaatgaagctggacggcaaaatcacccgcatcacggacgaaccgctgacggcggaaaaatgtatggaaatcgccttttcgattatgagtgcgaagcaggcggaagaattttcatcgaccaacgagtgcaacttcgccatcagcctgccggacaccagccgcttccgcgtcaatgcgatgatacagcgcggcgcgacggcgttggtattccgtacgattaccagcaagattcccaagtttgaaagcctgaacctgccgccagtcttgaaggatgtcgcgctgaaaaaacgcgggctggttatttttgtcggcggcaccggctcgggtaaatcgacttcgcttgcctcgcttatcgactaccgcaatgaaaattcgttcggacacatcatcaccatcgaagacccgatcgagtttgtccacgaacacaaaaactgcatcatcacccagcgcgaggtcggcgtggatacggaaaactggatggcggcgttgaaaaacacgctgcgtcaggcgcctgatgtcatccttatcggcgaaatccgtgaccgcgaaacaatggactacgccattgcctttgccgaaacggggcatttgtgtatggcgacgctgcacgccaacagcaccaatcaggcactcgaccgcatcatcaactttttccccgaggagcggcgcgaacaattgctgacggatttgtcgctcaaccttcaggcgtttatttcgcaacgcctcgttccgcgagacggcggcaagggcagggtggcggcagtcgaggtgctgctcaattcgcccctgatttcggagttgattcacaacggcaacatccatgaaatcaaagaagtgatgaaaaaatccactaccctgggtatgcagaccttcgatcaacacctttaccaattgtatgaaaaaggcgatatttccctgcaagaagcattgaaaaatgccgattccgcacacgatttgcgtttggcggtacagttgcgcagccgccgcgcgcaaagttccagccccgatttggaactgctctgatggcggtatggatttccggacggatggtttgaaatgatttatccgtggcataatgagcaatggcggcagattgcggaacattgggagcgtcgtcccaatgcatggctgtttgccggcaaaaaagatacggggaaaactacatttgcccgctttgcggcgaaggcactgttgtgcgaaacccctgcaccgggctgcaaaccctgtggcgaatgtatgtcctgccatctgtttggacagggaagccatcccgatttttacgaaatcacccccttgtcggacgaacccgaaaacggacgcaaactgttgcagatcaaaatcgatgccgtcagggaaatcatcgataatgtgtacctgacttcggtacggggcggtttgcgcgtgattctgattcatcctgcggaaagtatgaatgtccaagccgccaacagtttgttgaaagtgttggaagaaccgccgccacaagtggtctttttgctggtcagccacgcggcggacaaggttttaccgaccattaaaagtcgctgccggaagatggttttgcccgctccttcccatgaagaggcattggcatatctgcgtgaaaggggtgtggcggaacctgaggaacgtctggctttccattccggagcgccgctgtttgatgaggcggacggtgtccgtgcgttgcggattaaactgttggatattttggcagaaccaaggttgttgaagattttggattacgccgcgcttttcgataaggaaaaacttccgctcgccgtatttgtcgggtggatgcagaaatggctggtcgatttgggattgtgcctgcaacacatgaaacccgtctattatcccgcttatgaagacaggctgcttcagacggtatccggtttccgtccgcgcaatgtatttgcggcggaggatatgctcaaacagcttgccccctacgggtttcatactttaaatgtcaaaatgcagatcgagcatctgctcatcaactatttggaattgaagaaagagaacgggtgaattatgtcagacggacaaaatattccggcaaaaatgatgtcgttgcagctgaaagacatgaatctgctgtacagctcctacatgccgtttttggaacacggcggtctgtttgtgcagaccaacgacgtattttccatcggggacgatattctgcttgccgtagaaatcctcaacttccccaaactgttcctgccgaccaaagtcgcctggatcaatcctgcgcgtacttcctccaaacccaaaggggtggggctggcattcacaaaacacgaaaactgcctgaaagtcaaagaccagatcgaagtcgaactgggcaacacaatcggcggcagcagacctacgtttaccatgtaacgccatgcatatcatcgattcgcactgccacctcaattttgaaggtttgaaagaacgcctgcccgaagttttgtccaacatggaagcaaacggcgtggggcaggcactcgccatcagcgtcagtagggaaagcttctccgaagtctttgccatcgccgaagcgcacgaacacatctattgcaccataggcgtacatcccgacagcaaggaagccgaagaattttccattgcggaaatggtcgaagccgccgcccatccgaaagtggtcggcatcggcgagacgggtttggattattactggtgcaaaggcgatttgtcctggcaacacaaacgctttgcagaccacatcgaagcagccaatcaaaccggactgcccgttatcgtccatacgcgtgatgcggcggcggacaccttgtctatcctgaaagaatgccgggttaattcgggcgttatccactgtttttccgaagacatcggttttgcccgtgcagcaatggatttggggctttatatttctttctcgggaatcgttacctttaaaaacgcacccttggttcaggaggcggcgaaatatgtgccggacgaccgcattttggtggaaaccgatgcgccgttcctcgcccccgttcccaaacgcggcaggcagaacgaaccggcttttgtgcgccataccgccgaacatatcgccaaattgcggaaccaaacattggaacaggttgcggcatatacgacggaaaacttttaccggctgtttaaaaaagtacccgatatgcggaccgtctgaccctgtaccgacgataaggaaaaccatgaaggcaattcatccgtatgcatgtccgcgctgctgccggctgcctgccaacacgtttcggacaggcatggcaaattccgcttccaaattctgcattgccaaaggcggcagacgggaagcaaaaaaagacgaaagcggcggcggatatgccctgtgccatttgccggacagcaggattgtcgaggagtgggaatatttccgttcacaatattgatactgcgcgatatacggcaaatattgtgggaagtttccgcttttgcgtataatgcgccctacctgacaaattttgtcaactttatcaaaaggaataagcgatggcttccatccacgaccaaattaaagaagtagtaacgacacaccgcgtcgtattgtttatgaaaggtacgaagcagtttccgcaatgcggtttctcttcccgcgccgtgcaaatcctgaacgcggcaggctgcaccgattacgttaccgtcaacgtattggaaaatcccgaagtgcgccaaggcattaaggaatacagcgactggccgaccatcccccaactttatgtgaacggcgagtttgtcggcggttcggacatcctgatggaaatgtatgaggcaggcgagctgcaagagctgctgaaagcctgatggattcggcaatgccgtctgaacgtgtttcagacggcattttcttttccggcaaatcaaaaaaaagtataatggcgcgtctcaaaatcacattggaacaccgcgatgaacgttaatgttatcaaccatccgctcgtccgccacaaattaaccctgatgagggaggcggattgcagcacctacaaattccggacgcttgccaccgagctggcgcgcctgatggcatacgaggcaagccgtgattttgaaatcgaaaaataccttatcgacggatggtgcggtcagattgaaggcgaccgcatcaagggcaaaacattgaccgtcgttcccatactgcgtgcaggtttgggtatgcttgacggtgtgctcgacctgattccgactgccaaaatcagtgtagtcggactgcagcgcgacgaagaaacgctgaagcctatttcctattttgagaaatttgtggacagtatggacgaacgtccggctttgattatcgatcctatgctggcgacaggcggttcgatggttgccaccatcgaccttttgaaagccaagggctgcaaaaatatcaaggcactggtgctggttgccgcgcccgagggtgtgaaggcggtcaacgacgcgcaccctgacgttacgatttacaccgccgcgctcgacagccacttgaacgagaacggctacatcatccccggcttgggcgatgcgggcgacaagattttcggcacgcgctaactgactgattttcggagttgatatgaattttcaagactatctcgccacatttccttcaatcgaccatctgggcggtttggacgttcaggatgccgacggcaaaacggttcaccacattcctgccgttcagggtaagctcggttcgctcaagctgtacaatgctttggcggaacgttttgacggaaaattgggtaaagaagcggcagaacagggtttgatatggtttgccgaacacgttgccgacgcgcgtgcccatccgggcaagcatccgaacatcgatctgctggaaaatgtcgtgcaaagcggtgaaacctggttgctcaagccgctttccgcgcaataattttcgaccatgccgtctgaaatccgtttcagacggcattttgtcggaaagaagaccgtaaaacgggcattttcttttctatttcaggatacgggcaatgatgtttcaacacacaggacgacacataaagcgccgccctatgtgttgccctaatttggaaggggttacacccttttcaaataaaatctgatgctgctgccacgaaggacggatgtccgagtggcggggtttcaaccattaaggaaatacgatgaaaaaaatgttcctttctgccgtattgcttctgtcggctgccgcccaaaccgtgtgggcggatacggtgttttcctgtaaaacggacaacaacaaatacatagaagtccaaaaaatcaaccgcaatctttacgaatattcgttcggcagtgcggcaaaaaaagaaattgccatacgcaacagcaaagctgacctgttggggcgttccgacaggtggcaaggtatgggcagcggtcgttgggcaacgatgaaattccaaaacggcgaatttatgtacaccatatggacaggcttcgattccgtgactcatacggaaagcagcggtgtcgttgtggagcgtaggggcaaggaagtcgcacgggtcggctgtacgccgaaaaccgcgcaggcgaatttcaacgatgacgatttttcctagtaatcggggcggataaggcgatggaaacagcgaaacccgtcatgctgattgtccgtccgtcgggcagggccgcagaagatgtcgaaacttgcctgaatgccggttggcgcgcggaagtattgagtccggtcgaaatcgaagcagatgctgccggactggaacttttgtccgaacaatatgcccgtgcggatgccgtgttttgggtcagtccgaccgccgttgaaaccgccgtcccgtaccttaacctttcagacggcataaaggcgcagattgccgtagggcagggcagccgccgcgcattggaacgctgtttggtcagaacggtcatcgcgcctgatgacggcaacgacagcgaggcggttttgcgcctgccggtttggaacagtctgcccgaaggtgcgcgcgtattgtttgtgcgcggacacggcgggcgggattttttgatgaatgccttgcaggagaaaggttttcggacggaggtggcagaagtctatttcagacggcataaacctttgaactttcaaaatttccaaaccgaaaatattgccgccgcctatattacgtcgaccgagctggtgcgcttgctgttcgggcagcttccgccgcaattttcccgattcttcaaatccttgctatactttacccatcatccgcgcattgcggaggcattgaagcgcgaaggcgtgtgttcggtcgaaaccgtccctacgctggaagccgcgctttcccattcttccatttccgtttcagacggcatggtctttcccggaacctcaaattaataaggagcaaaacggtgggcgaacctgaaaacaaatcatccgaacccgtacgcgagatacaggcatcaaaagaaatgccgtctgaaacctcttccccacgcaaagaaaacgaaacagaagtacacattcctgccgctccttttatcgtcaaacagtccggcagcaacgctttggcagtctgcgccctggtattggcggcattgggtttgggtacaagtggttttttgtttgtccaaggacagaatgtcttgaaaaaccaagagctggcattcaaccaaaaaatcgacaaagccgccttgggcgagtcggaaaacgccgccctgttgaaagacaacctcaaccggcaagccgccatacaatcagagctcgaccgtttggacggaaacgtcaaagcaaacggcgaacaaatcttggaaatgcaaaaatcctatcgcgagttgaccaaaggacgcgccgattggctggtggacgaaaccgagaccatactcaatctggcggcgcaacagctggtgttgactggcaatatccaaacggcagtcggcgtattggagcatatcgacagccgcctgtcccgtttcaatcaggcagagcttctgccgatcaagcaggcggtcagcagcgacttggcggaactgaaaaaccgtccctatgtcgatatttccggcacggcattgcgcctcgacaggctggaaaccgccgtatccggactgccgctgatgctcgacggcgtgctgaaaccgggcgtacaggtgaagaacgaagccgcttccgcttcatggtggcagaacgtatgggaaaaatccctcggcacattgaaggggctggtcgaaatccgacgtttggaaaacaacgatgccatgctgatttctcccgaacaggcatattttgtgcgtgaaaacctgcgcctccgccttttggatgcgcgcactgcattaatgcagcgcaacagcgaagtctatcagggcgatttgaacaatgccgaagccgccgtcagacagtatttcgatgccaagtctcccgccacgcagtcgtggctgaaagaactggcggaattgaaggcgttggatgtgcggatgactgcggatgacggtttgaaaaacagcctaaatgccgtccgcgcctatcgcgacggtacgcgcatgacggcggcggaaaatcaagaagcggaacaggcggcttccgaaccggcaaacgaaaaaacagcttccgaaccggctgccgcatcggatgtgaagaccatagaagcaccgtccctgccttcggaacgcaaaccggaacagcctgcaaaaaaacagaccgtaccggaaaaggcagggcgttcgccgtccgctaaaggagaacgcgcatgaaaacggtagtctggattgtcgtcctgtttgccgccgccgtcggactggcgctggcttcgggcatttacaccggcgacgtgtatatcgtactcggacagaccatgctcagaatcaacctgcacgcctttgtgttaggttcgctgattgccgtcgtggtgtggtatttcttgtttaaattcattatcggcgtactcaatatccccgaaaagatgcagcgtttcggttcggcgcgtaaaggccgcaaggccgcgcttgccttgaacaaggcgggtttggcgtattttgaagggcgttttgaaaaggcggaactagaagcctcacgcgtgttggtcaacaaagaggccggagacaaccggactttggcattgatgctgggcgcgcacgccgccggacagatggaaaacatcgagctgcgcgaccgttatcttgcggaaatcgccaaactgccggaaaaacagcagctttcccgttatcttttgttggcggaatcggcgttgaaccggcgcgattacgaagcggcggaagccaatcttcatgcggcggcgaagatgaatgccaaccttacgcgcctcgtgcgtctgcaacttcgttacgctttcgacaggggcgacgcgttgcaggttctggcaaaaaccgaaaaactttccaaggcgggcgcgttgggcaaatcggaaatggaacggtatcaaaattgggcataccgccgccagctggcggatgctgccgatgccgccgctttgaaaacctgcctgaagcggattcccgacagcctcaaaaacggggaattgagcgtatcggttgcggaaaagtacgaacgtttgggactgtatgccgatgcggtcaaatgggtcaaacagcattatccgcacaaccgccgccccgagcttttggaagcctttgtcgaaagcgtgcgctttttgggcgagcgcgaacagcagaaagccatcgattttgccgatgcttggctgaaagaacagcccgataacgcgcttctgctgatgtatctcggtcggctcgcctacggccgcaaactttggggcaaggcaaaaggctaccttgaagcgagcattgcattaaagccgagtatttccgcgcgtttggttctagcaaaggttttcgacgaaatcggagaaccgcagaaggcggaggcgcagcgcaacttggttttggaagccgtctccgatgacgaacgtcacgcagcgttagagcagcatagctgattttgggaaatatctttatctgggagaatttgatggggtcttcagattcctttaaggaaaagaaagaaatatttgaaattggaacgcctgcttatcgccaaaagttaattgatgtttggaaaaagagcattaatggaaacgaaaaatcttgggtgctctttgaaaatgggacttgcgtcattttacttgaaccggaaaaagatttggcgaaacaagctaaagagatgttaagcaaatggggcaaggttcaaataggaacaccatctgcagattttggcattatcactttagatagtggcgatggatatgccgtttcatgccatcatcccgaaatttttacgctaatcctaaaagaagaaggattggatgaagatttcaaaatcggtatcgaagggcgctctcatcgcgattgtgatgctgaagaacccaaagttatccatatcgaagataaacgcaccattgaaaccccatgaaaacctgctgccgtttaatcatctactgatgattacttaggcaaatgtgcccgtccctcccttttcagacgacctttcattgcggaaaccgccgcaaaggttgtctgaaaaccgttttccttccccgttttacaaacaaaccgaaagccccacatgatctctttgaaaaacgacactttcctccgcgccctgctcaaacaacctgtcgaatacacgccgatttggatgatgcgccaggcggggcgttatctgcccgaatacaaagccacacgcgcgaaagcgggcagcttcctcgatttgtgcaaaaacaccgaattggcgaccgaagttaccatccaacctttggaacgtttcgatttggacgcggcgattttgttttccgacatcctgaccgtccctgacgcaatgggcttgggactgtattttgccgaaggcgaaggcccgaaattcaaacgcgccctgcaacacgaggccgacatcgccaagctgcacgttcccgatatggaaaaactgcaatacgttttcgacgcggtaacttccatccgtaaagcattggacggccgcgtaccgctcatcggcttctccggcagtccgttcacgctcgcctgttatatggtcgaaggcggcggcagcaaagaattccgcaccatcaaaaccatgatgtactcgcgccccgatttgctgcacaaaatcctcgataccaacgcccaagccgttaccgcctacctcaacgcccaaatcgacgcgggcgcgcaggcggtgcagattttcgacacttggggcggcgtgttgagcgatgcggcgtttaaagaattcagcctcaaatacatccgccagatcgtcgccggactcaaacgcgaaagcgaaggccgccgcgtgcctgttatcgtatttgccaaaggcggcgggctgtggctggaaagtatggcccaaatcggcgcagacgcattgggcttggactggacgtgtaacatcggcgaagcacgccgccgcgtcggcaagcaagtcgccctgcaaggcaacttcgacccgttcgccctcttcggtacgccggaatccatccgcaccgaggtcgcacgtatcctagccgactacggacacggcagcggccatgtcttcaacctcggacacggcatcaaccaacacgccgaccccgaacacgccaaaatcttagtcgataccgtacacgagctgtctcggcagtatcacggcgggtaagccggcaggaaaccgcccgatatgccgtctgaagccgagagatggccggttagggtaaaaataaggcaatgcggcaatatccgccgtgtacggatagtacatgacggcggcgttgtcgtattggcgcaatcccaaccgtccctatgttcagacggcatttttgttttcagatgcagggaaaaccgatggcaaaaacgcttaaaaccctttaccaatgcaccgaatgcggcggcacttcgccgaaatggcagggcaaatgcccgcattgcggcgagtggaacacgcttcaggaaagccttgccgcgcccgagccgaaaaacgcccgtttccaatcttgggcggcggatacctcgaccgtccaatccctctccgccgttaccgccaccgaagtgccgcgcaatccgaccggtatgggcgaactcgaccgcgtattgggcggcggtttggtcgatggtgcggtcatcctgctcggcggcgaccccggcatcggcaaatccacgctgctgttgcaaaccatcgccaaaatggcgcaaagccgtaaagtgctatacgtttccggcgaagaatccgcccaacaagtcgccctgcgcgcgcagcgtttggaactgccgaccgacggcgtaaaccttcttgccgaaatccgcatggaagcgattcaggcggccttgaaacagcatcagcccgaagttgtcgtcatcgactctatccaaaccatgtattccgaccaaatcacgtccgcccccggctccgtgtcgcaggtgcgcgagtgtgccgcccaactgacgcgcatggcgaaacagatgggcatcgccatgatactggtcggacacgtgaccaaagacggcgcgattgccggcccgcgcgtgctggaacacatggttgataccgtgctgtatttcgagggcgaccaacattccaactaccgcatgatacgcgccatcaaaaaccgcttcggcgcggcaaacgaactgggcgtgttcgcgatgacggaaaacggtttgaaaggtgtgtccaacccgtccgccatcttcctcgccagctaccgcgacgatacgcccggctcgtgcgttttggttacacaggaaggcagccgcccgcttttggtcgaaattcaggcattggtcgatgacgcgcacggcttcacgcccaaacgcctcaccgtcggactggaacaaaaccgtcttgcgatgctgcttgccgtgttaaaccgccacggcggcatcgcctgtttcgatcaggatgtgttcctcaacgccgtcggcggcgtgaaaatcggcgaaccggcggcggatttggcggtcatcctcgcgatgctttccagcttccgcaaccgccctatgcctgaaaaaaccgtggttttcggcgaaatcggcttaagcggcgaagtccgccccgtcgcacgcgggcaagagcggctcaaagaagcggaaaaactcggcttcaaacgcgccatcgtccccaaagccaatatgccgcgcaacgccaaagagtttccgaacctgaaaatctacggcgtttcgagtttgcaggaagccatcgatatttgccgcgacagcagggaataaacggaaatgccgtctgaaatcgggtttcagacggcatttggtttgtggcggattgaaacaagaaggcataccggcgacagataagatttgcggcaaagttgcctgtgatgtggcaaaaacacacacgcccgtcatccccgcaagggtgggaatccggaatcgtccgtttcggcaatgattgaaaatcacggtaacccaaccgattggattcccgacttcgtgggaatgaggggcgtgtgcatttgatttccatccgccatatgtcggcgacgggcttattcgcctacggttttttgtatcagtttttcggcgtttgccaaagtgtttgccacttcgtcgaaaccgatgcggctgccggcgatgagggcgcgcgtatcggtataggcggcgcgtactttgccgtccgtttcggtaacgaggacgcgtaggggcagttgcagggcgaaggcggggtctttgaccatcagcggcgtgccggctttgggcgtgccgaagacgatgacttttgccggctgcatcgttaagccgtttcggcgggcggcttcctgatggtcgatgacggcaaaaatgtccatccctttgctttttatggcggtttcaaggcggctgacggtttcgtcaaaactgtattttgaggtgagggtatgcgtggtcatagcggtttcgttttgggtggacggttcgctggcaggatgtgccgaagcggttgaaatgcagagtgcggatgcggcaatcagggggagtatgtgtttcatcgtatttcctttttcctttttggttgaaacggtagaatcagactttattcgggaggggtgtaaccctttccaaatcagggcaacacatagggcggtgctttatgtgtcgtgaaacatcattgttccttatcggtttgtttatcaggcttcggacggggcggcgcgcgccgcgcccgatgttgcgccgcgtgccggaacgccgtatgccgtctgaaagcctgtcctttcagacggcattgcgtcatttcatcccttttttgagcaggtcttcataaccgccgtgattggcaacatttgtataacctgcttttttcagctcttgaagggcggcttcggcacgccgtccgctgcggcagtagaggttgaccggcgtgtctttgtcgggcgcggcttcgtgtatgcggcggacgatttggtcgacggggatgttgaccgcgttgtgcaaatgcccttcgctaaattcctgttcggaacggacatcgatccaaacggccggatgttgcgcggtttgggcggcggatacgggtttttgcggggctgcctgcgcggcaaaggcggctgaggcaatgagtgcggcggtaatcaggtgtttgatattcatagggttttcctgcggttgttgtccgaaaggacgggaagttattttatctgttccaaagcggcggcatctatgtcccaacgccaaacgccgccgcctttgccatccaatccgcgcaaaaacaggtagcggacggaaacggcggcgggcggttgtccgcgcagcttgaagtagcgtgcggcggcaacggcgtaaatcagtgcctgaaggtaatagtggtggtgtgcgacggcttcgtccattgcctgttgcgtgtaggcggatgcgtccgtaccgaggtggtttgatttgtagtcgatgacgcagatattgccgtcggggtcttggcagaccatatcgacaaagccgtttaaaaagccgttgacggtgtggaagtcgagcgtttcggcagcggcacggcagacttcgggcagcctgatgtcgtcgcgggcaaaccagtcgcgcaggcgtttgaggctgaagtcttcggtgtggagggtaaagcccatttcgggacagcggcactcgggtgagatgtcggacaggtcgtatgcccccgtcagcggcgttttgcggcaggcttccgccatttcggcaacggcgggcagccatatttcttcaaaaccgtattttttcagcttgtcggcaatgagggtttcctgtccggcggctgcttgtccgaatttgaaatcttcaagaatttcgtgcaggcacagccccgcctgcgtgcctttcggaaaatcgtgtatcgatatgccgtctgaagccgtcggcgtttcagacggcatcgccggcaccgaggtttcggcggcatccaaggacgggcaggcatcttcttcgccgccgtcgggcgtttgggtatggcggcttaaggcggtaaagctagtgtggcggacaaatcggaatccgcgttcgggaatgctgtttgcggcaaattcggcggtttgaccggcgttgctgcgataggcggcagggggcggcgcattttcggtgaaggcgaaatttgtgccggaaggggcgttgtccgccacgcgccgccagttgcgtttgagcatcgcgatgccgtctttttcacacgcataggcacggcggacggtttcacggctgtcttggggcgagccttcaatcaggtaggcgagggggttgtcggcagtattggtggagtacgcggcgtagatgttgagctgttcctcggcacgcgtcagcgcgacataaagcaggcgcaggcgttccgccatttcttcatcggcgtattgtttctgttcgtcttccgacagttgcgcctttgccaacagttcggttcggtttgcgccttggtggaggatttgccagtcggacggtccggtatcttgcgcgtcccacgcaaacgggcagtacaccagcggatactgcaaacctttcgaggcgtgcatggtaacgattttgaccaaatcttcgtcgctttccagacggatggcgcggttgtcgccgctgttgttttcggcaaggctgatttggtcgcccagccatttgtgcagcgcggcggggttgcggttttgcgcgtcttcggcggcaagcagttcgagcagttggaaataattggtcagactgcgcccgttgttccggcttaagaggcgcgtttcgatgccgtgtgtttgggaaaattgctgcatagcggcgaaaatgccgtatttattccagttgtcgagtgcggttcgggcagattccgcccaatgcaaaatctcgctttcgttttggttgaagtcgtgcaattgctgcgcgtcataaccgaatatgctgcttgtcaggacaaaacgcagcgttccggcgcggcgcggttcgagccagaagccgatgagtgcggacagggcggcggcttcgggcgaggcgaacacagattcgcgcgaaagcaggacgctttgcacctgccgttttttcagggcggcggaaaccatcaccgcctcgttgtgcgtgcgtaccagcacggcaatatcgcccgactgcaacgggcagcctttgaaattcagacggcctctggcggcttcgttgagcgcgtgggcgatttcgtcggcgcaatagtcggcggcacggcggcgcaaaacgtctttgttggctttttcattgtcgttttcgtgcagccaacgaacctgtacggcaggacgttcgggggacagcctgctttcggcacgcgccgcaccgacttccgaatagccgatgttttccaaaacgaacgggcgttctttgaggcggaacagcgcgcctatgctgccgataagcgcggcgtggctgcggtagttggtggcgagcgtgtagcggtgccgcgcgtcttccgccgcctgaaggtaggcgtaaatgtccgctccgcgaaagctgtaaatcgcctgtttgggatcgccgacgaggaacagcggtcggttttgggcgatgaaaatcttttggaagatttcgtattgcagcgggtcggtgtcttggaactcgtcgatcagcgcggtttcccagttttcggcaacggcgcgggcgagagtgtcggcgtgcggattgtcggtcagcgcggtgtggacatcgagcagcaggtcgtcgaaaccgcgttcgcggcgcgattttttcatctcggcaaggctgcggttgaggtattcgattaaatccagttgcagccggatcattgttgcttcttccgcttcttcgagtgcgttcaaatcgcgcccgaagtctgccagtttctgcaattcggcaaatactgccgcatcgggcgttttgccttttttcagtccggcttcgagtttgtcggatgcaagtttcaagagtctgtcgtgtgtgtctttgtccagaaagggcagttgtccggcggcggatttttgtgccagttctttaaaaaggttgccgaagctgtttttgcggtaactgttgccgttgaggtcgggatgaatgcgccaaaagccggcttccagttctggcagcaggcggcagatggtttgccatgaggtttcggcgttgcgctgcgcctgtttcaaatccgcctgcggacggcggaaattcaggtacgggcgggaaagatagcgcgaaatttgggcaaggacggtttgcggcacagctttgcgtttaagcgccaatgcggcaagcaccggatcattgctgacgcgttcccgccaaaaatcttgcgccgggataagcaggcggtcgccgtcttcttcggtcatttcgacatcgaacggtgcttggcacaggaaggcgtagtcgcgcaggatgcgctggcagaagccgtggatggtatagatggcggcgttgtcgaattgcccgatggcggccttgaggcggacaatcagacgcgtccggccctctttttgcaaagcctgttttaagagttcgggcaggaaggtgtcgccttcgtggtgttcggcgcagtaggcggcaatgccgtctgaaagcgtgtcgtctccaagtttggcaattcctttgctttctaaaacttgtaacacatcgtccaaacgcccgcgcaggcgtgttttcagctcggcggtggcggctttggtgaaggttacgaccaatacgcgttcgacgtttttttgttctaatacgatcaggcgtgtaaacagggcggcaatgccgtaggttttgccggtgccggcagaggcctcaatcaggttggtgccggaaatggggacggttagcgggtcgaatgcttggatgcttgcagacatagtgcgcgctcggaaaacggttggacggtaaaacgggaaaatgccgtctgaaaaatggtttcagacggcatcgtccggcttagaggttttgcaggcgttcgacagacggcgcgtagtagtatccgcccgaaacggcggcggagagatgtcggagcagcaggtcggttttgccgtccgtatcgccgaacatactcaataattgcgcttcgatattgtgcagcgtgcggcagtatgcggtaaacatcaaaccgtgttcgccgctgattttgccgaagggcaggctgcggcggacgattttcaggccgactccgttttctttcaggttgacgcggccgaggtgcgaatcgggcaggcggacatcgcggccgaattcgtcgtcggtttccttgccgcgtccgaccgaggcctcctgttcggcgacggggacggcatcccattttttcaaatcgtgcaggtatttttgcagcaggacatagctgccgcccgcatcgggttttccttcggggatgatggcgacttcgcggacattttcatcgccctgcgggttttccgtgccgtcgacgaaaccgtccagcccgcgatcctgatacaggcgcaaaccgtgttcttcggacgcgacgcatatgctgtcgccgaacgcgcccaaaacggattgggcaagcgcgtaggcggcgttttggcggaaggattggatgtggatggacatatcgtgctgcgtggacggcgcaagcccgttgcccatttcggagaagggtttgatttcactgccttcgtccgtatgtccgaatgttgcccaggctttgctgccgaaggcgatggtcagacccaaaatatcgtccggaaagcgggctttcaaggcagttaacgcgtcgagcgaagcgcggcaggcggctttaatatcgttgaggcgattggcggcgaagtcggcttcgataaagatgccggcttgggcgtggtcgggaatgatggcggattggggcgtgttcatgagatgttcctttttggtgtcatctgtttcggatagattatagcaccgaatcggcaggcggatttttgccggaacggcgtgcgtgaatccgccgtttacatacctgatgccgcttttcggtttcgtgccgcccgccgcctttcccgccccctttatttccgcttccggcggcttcggcatatcttttccattccgatttggaataaccatataaaaaaagtattctttgtgtttgccgcaatttcacttagaatgccgcacttgcacactttttacaggagaggatgatgttgaaaaaattcgtactcggcggtattgccgcattggttttggcggcctgcggcggttcggaaggcgtgcagcggagcg

SEQ ID NO: 37818 - DNA, 11658 bp, Neisseria meningitidis
  misc_feature (2829)..(2829): N is any nucleotide
cggaaagaagatctcatattttcctcaacaataaacagtcagacaattaggaaatatactagcatttttttcaggcggcataaacattaaaaaagtgtaaatttgatataccgtctgaagatttcaattggatatttatagtggattaacaaaaaccagtacagcgttgtctcgctttagctcaaagagaacgattctctaaggtgctgaagcaccaagtgaatcggttccgtactgtttgtactgtctgtggctcgccgccttgtcctgatttttattaatccgctataaagaccgtcgggcatctgcagccgtcattcccgcgcaggcgggaatctagtcggttcggtttcagttatttccgataaatgcctgttgcttttcatttctagattcccactttcgtgggaatgacggttcagttgctacggttactgtcaagtttcggttatgttggaatttcgggaaacttatgaatcgtcattcccgcgcaggcgggaatctagtctgttcggtacggaaacttatcggataaaacggtttcttcagattttacgttctggattcccactttcgtgggaatgacgggatgtaggttcgtaggaatgacgtggtgcaggtttccgtgcggatggattcgtcattcccgcgcaggcgggaatctagaccttagaacaacagcaatattcaaagattatctgaaagtccgagattctagattcccgcctgcgcgggaatgacgaaaagtggcgggaatgacggttcgggcattccttaaatcacccgtgtatcgctgtaaatcttagagatggcggaatatagcggattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactataaaattccggattcccacttttgtggaaatgatgagataaacgtgattatggtttaaacggggcgtatgcccattccccgggttttaaatccaaatcaaacagtttcagcctgccgcttgccactctgatcagacgcaggcagggatagcccgccttggcggtcattcgcctgacttggcggtttttgccctcagaaatggtaatttcaatccaaaaatcgggaacggttttgcggacgcgtatcggcgggatgcgctcccataacgaatctgcttctccgtgtttcaagatgcggatgcttgccggacgggtaacgaaaccgcctaagtctatcccttttcttaggctttccaatcggctttcgtcgggtacgccctccagttgcgcccagtaggttttagggtgtttgaatttggggtcggtaatttgtgcctgaagcctgccgtcgtcggtcagcagcagcagcccctcgctgtcggtgtcgagccgtccggcggggtagaagccgggaagattgataaagtctttgaggcttttgtgtttttcgtgcggtgaaaattggcagataacgccatagggtttgttgaaggcgatgaggtttttcatagcttttgggtttgggttgaaatgggcggcggtatcgggaaaatttgtttattgcgaagggacatccgataaatggtgcttccaaagtgaaaaggtttgaatgcagattaaattttaaggtgcatgaaatggattttcaattctttgtcgaaacaatccgccgacaggaaaagaaactgaagcatggcgtgtaccggctgtttgagatttacagttggttggaagatggaaaagcaacaaaggcgcgtatccggtattttgtcaaaattgaggtcgataaacagatattgcgaaggattcatcgtggtatagcggattaacaaaaaccagtacggcgttgtctcgccttagctcaaagagaacgattctctaaggtgctgaagcaccaagtgagtcggtttcgtactatttgtactgtctgcggcttcgtcgccttgtcctgatttttgttaatccactatattataaaaattccgtctgaagcggcgttcagacggaatttgtttcaagcaggcttaacagcagcgtccgccgtttgcgccgcagcggcgtttgcggcaatagtcttgaaactgcagcttggtcatcacgggggcgttgggattatgtttgcgctgctgtgcaacgtagttttcataatcgggcacgcctgccatcaagtttgccgtcagcttgatggttttccaccaagacgcgagcttatgcttcactttgtgcctccggctgtttgccgtcgcggtacaccgccgggatttctttggcggtcggccagccgactttgcgtgctttgagggcggtacgcaaaccgtacgcggcgacaatcacgacaaccgacaagaagaggatggtcagaccggcattaatcttgtcgttgaagatgatttgcgccatttcgccgatgtctttggcaggcgcaaggatttcgtttttagccaatgcgtcgctgtatttgccggcgtgggcaaggaagctgatgcgcgggtcgctgtggaacagtttttgcaggccggcgtagcaggttacgaacagtacgccgacggcgggaacgagtaccacccagacataacggtcgcgtttcatcttaatcagcaccacggcgcacataatcaaggctacgcctgccagcatttggttggcgatgccgaacaaaggccagagcgagttgatgccgcccaacgggtcggtcacgcccgtgtagaggaagtagccccacaatgccacggcgaagaaggtcgcaatcaggttggcggngatggagtcggtgttgccgaaaggtttgtagaagatgctgcccaagtcttgaatcataaaacgtgcgacgcgcgtaccggcatcgacggcggtcaggatgaacaaggcttcaaacaacagggcgaagtgataccagaacgccatcatcgcctcgcccggaatcaggcggctcataatgtgcgccataccgactgcgagggtgggcgcaccgccggcacgggaaaggatggtgttttcgccgacttctttagcagtgtgcaacagggttgcggcatcgacagggaattgcagcttggtggtaatcacttcggcggcggtattggcatccgtaccgatcagggcggctgggctgttcatggcgaagtacacgccgggatcaagcgatgcggcagcggcaagtgccataatggctacgaaactttccatcaacataccgccgtaaccgatcatgcggacgtgggtttcgttttccagcattttcggcgtagtgccggaagaaatcagcgcgtggaagcccgaaaccgcaccgcaggcgatggtaatgaacaagaatgggaacaatgcgcctgagaataccggacccgaaccgtcgataaagtgggttacggcaggcatttgcaaagcgggattgacgatgacgatacccaaagccaaggccgcaatcgtaccgattttcaggaaggtggagagatagtcgcgcggagtgagcagcaaccatacgggcaatacggaggcgacaaagccgtaaatcataatcgcccaagtgagctggatgccgtcaaggtcgaaccaatgcccgatggaacttttagccacatcttcgccgtaaattaccgccagcatcagcaaaataaagccgacgatggaaatctcgccgattttgcccggacggatataacgcgtgtaaatacccataaacagcgcaatcggcatagttgctgcaatggtgaacgtaccccaagggctgtgaaccaatgcttttacgacaatcaacgccaacaccgccataatgatgaccataatcatcaaaataccgatggaggcaatcacgccggggacagtgccgagttcctgtttcacaatatcgcccaaagacttaccgtcgcggcgcatagagacgaacaagaccatcatatcctgtaccgcgccggcaaataccacgccgaagataatccacaaagtaccgggcagataacccatttgcgccgccaaaaccggaccaaccaaagggcccgcgccggcaattgcggcaaagtggtgtccgaacaatacgcctttgtgcgtcggaacgtagtccaagccgtcgttgtggcgttctgccggagtcaggcggtcaggatcgagccgcattacgcggttggcgatgtagaggctgtaaaaacggtaggcgatgcagtaaacggatatggcggcggtgaccatccataccgcgctgacctgttcgcctcggctgagggccagagtggtaaaggatgctaagccgaccagtaccactatgccccaaatgaggaaggttttgagtgatttcatcgaataaatccttatctcacactgtcggaatatgcctgaacggcgggaaacggccgaaccatctgccggcacgggcacaaaccggagtctgaatgattgacgaagtatgaaacagtgcgcttgtcgggatttgtgccttatgcccgcatcaaacagtgcagggatgcgggcgcacaaaacgttaaacgccgaataggattttaacgcaaattagcacaccgatagcggtttttacttggaatttggaaaaaatttacattcctccgggcgggcaggcaggttcagacggcatcgtcaggcaaaaggcggcatcggaagaggggtaaagaaggggcgcgcaatccggattattgattcatcgcaggtaaattccggttatcgggcttgtgtgtttgcgcgtccgtttatagtatggcgttgccgcagcttggaatcagggcggttgtttcatatcttatttttattggggagcttttatgaatatcaggtttttcgcgctgaccgtaccggttttgtctttggcggcctgtgccgtgccggaggcgtatgatgacggcggacgcgggcatatgccgcccgttcaaaaccaagccggcacggacgattttcgggcgttttcctgcgagaacggtttgtctgtgcgcgtccgccatttggacagcggcaaagtcgcgttgcggctggacggcaggcgtgccgtcctctcttccgacgttgccgcatccggcgaacgctataccgccgaacacggtttgttcggaaacgcaaccgagtggcaccagaaaggcggcgaagcctttttcggctttaccgatgcctacggcaattcggtcgaaacttcctgccgcgcccgttaaacggggcagcctgtttgaaccgccgtccagatttttcgggcggttttttgtgtcggacggacggttttttgtgtcggatttgttttgcagttcggcctccggcagggttcgggctgcctgataccgtccgtaacttcgggtattgccgagttcgtcggcaacggccgctgcggcttgggcggcgttttgccgaacgcctgcgttacttccctttgtaggtcgatctctttggcaaccgcgtctttgtcaaagctgtttttcagacggccttttgtcaaatattatcggcagtggctcaatgccaactttaaacctgctccgatttcttcagggctgttatccaatgataaaatgacatcgtctgcatcaatggcattccacgcttccagcttgacatggcggctcgggctgattttcaggcagccgttgtgcagccaaatatccacgctcatcatgtttttaaatagggcgcgtctggttttatagcccaagttcccgcatagcttggcaacccaatcctcatagcgttgccgaattttttcggtatcaaaaaaatcttggtcttctggactgtcataaacgaaagtcctgctgtttgccaacgcttgcaagactgtcgtgcctaaagtttcattgtcggtatccaatggcaggatatgggggggatataggtggtctattgccgttaaccccaaacctgaacatgtttgaacaatcagagtttctttattagcatcaaaaactgcccaataattttgattctgtttaaaaatcattatttgatctccgtaattttgactgtatagtggatttaacaaaaatcaggacaaggcgacgaagccgcagacagtacaaatagtacggaaccgattcacttggtgcttcagcaccttagagaatcgttctctttgagctaaggcgaggcaacgctgtactggtttttgttaatccactataatgttcggatttttgccatactctaccacacgttgcaactgcaatctttgctccttatatattgcaccccatcaaagggctgcattacttttctttctaaagattactatcgtataaaaaatatttttcttaaacgacagggattgcgcccgcgccatattcagacaccgcccggatgttgcgctgcccgatcggatgcttcagacggcatcggaagggtttgcagttttggaatatgaagatgataatgtccgcgagattgacggcatttgaaagcggttattccgcataccggaggatacgaaatgaacgaatattcccaattaatcaagcatcccgatatttcccttcccccggtttcagacggcatcaaagtcgataatccggcaacgggcgagactttggcgtttgtccgcaagacggattcggacaagctgaaaaacctgattcaaaaagcagctgcagcacaaaaattatgggcggcaaaaactgcgttggaacgcgccgatgtgttgtggcgttggtattttcagattaaagaaaacaaagaagcattagcgcgcctgatgacgatggagcagggcaaaagcctgaccgaggcgcgtggcgaaatcgattatgcggcttcgtttgtgcgctggtttgccgaagaggcgcggcggattgacggcgatgtgctgacgagtgtgaaagcgtcgcaaaaactggtcgtgttgaaacagcccgtcggcgttaccgctgcgattacgccgtggaactttccgtccgcgatgattgcgcgcaaggccgcgcctgctttggcggtgggttgcgcgatgatcgtcaaacccgcatcgctcacgcctttgagtgcgtatgccttggcttcgttggcttacgaagcgggcataccgcaggatttgttgcctgttgtcagcggcagtgcttcggaaatcggccatgaatttgctacgaacccgattatccgcaaaatcagcttcaccggctcgaccgaagtcggcgcaaaaatttttgccgacagcgcggcggacattaaaaaactcagtttggagctgggcggcaacgcgccgtttatcgtgtttgacgatgccgatttggacaaagccgtcgaaggcgcgctcgccagcaagttccgtaacagcggtcagacctgcgtctgcaccaaccgcgtttacgctcaatccgccatttacgacgaattttgccgcaaattgagtgaaaaagcagccgcgctcaaattgggcaacggcttggaggatggtgtgaaccaagggccgctgattgaggaaaaagcggtggagaaagtcgagcagcacatcgccgacgcgcttgctaaaggtgcaagctgcctgaccggcggcaaacgcagcgcgttgggcggaacgtttttcgaaccgactgttttaagcggcgtaacggcgcaaatggcggtggcacgcgaagaaaccttcgggccgttgtgtccggtattccgttttgaaaccgaagccgaggtcatcgaggctgcgaacaatacggaatacggtttggcagcttaccttttcaccgccgacaccgcccgccaatggcgcgtcggcgaagccttggaatacggtatggtcggcatcaatacgggcttaatcagcaatgaagcggcaccgttcggcggcgtgaaacgtagcggtttgggacgtgaaggcagcaaatacggtgcggacgaatatctagaattgaaatatctgtgtatggatgtcgggtgacggatgccgtctgaacggcaggatttcagacggcgccgcattttaagcagtctctatctgttgtacaatgcgccctgtttttacggttatttttgatttgaacaagatatgatggaaaacggaaaaacagtcccgagatggcgttttgccttgaaaagtgcgggctggcacctcttaatcagcctgtcggttgcagggctggcggcattgctggtttttaaggtttggtatccttatccttatgccgagctgacgggagggctgtcgctttatcagctggtggtggctgtcgatattgtatgtggtccgctgctgactttaattttggcaagcccgaagaaaaagacaaaggcacgcatggtcgatttttccatggtcggcatcatccagctggcggctttggtgtacggtctgcacagcgtttcgctggcgcgtcctgtggtggaagcgtttgaacaggatcgtatgaccattgttacggcggcggaagtcgtggtcgaagatttgcacaaagcccccgaagggctgcaaagcctgtcgtggttcggcatccgccgcattgcattgaaagaacctgaggatgcggatgagaagaacaagacgctggatttgtccctgaaaggtatcgagccgagtatgcgtcccgaccagtggctgccgtattccgacaaggaagcagaagaaatccgcaaacatctgaaaccgctgaaagtcttggcggatgcgagaaaaacgacggttgcggacattctgaaacaggcaggtctcgccgaaggggaggagctgtattacctgccgtttaccagcagcaggcagaaagagtggatagtcattaccgataaagagggcaacaccaaaggctacgcgccgatagacggcttcatcatcaccccttaagcgttgggactccgtccgcactcgaacatccgttcttcgcggcggtagaatcagactgtatttgagaggggcgcaacccctcaatcagggcaacacataggggaaggctttatgtgccgtccgtgtgttgaaacatttcaaaataagctcatgccgtccgaacatcctttcagacggtatggcgttttgccattgccccgataagctgttaaactatttaaattatttcgaccgaaggtacacgcacatgcaagaccccgagcagagcagcaagcccgcccgccgttttttgtgcgtaccgtctgttcaggcagcttgagcgcttcaggctgccttttcgcgtttgaacttgaggaatacgaaaatcatggatttcagttggttggcagaaccgcatacctggataggttttgccacgcttttggtgttggaagtcgtattggggatagacaatcttgtctttgtggcgattttggcaaacaaggtccagcccgcacggcgcgaccgcgcacggattatcgggctggggctggcagtcgtcatccgcatcattatgcttgcttttatggcgcacatcatcacgctgaccgagccgctgttccaaatcggcggcctcgccgtttccggcaaggacatgattatgctcgcgggcggtattttcctgctttacaaagccaccaccgaactgcatgaacgcctcgaagggcacaaccgttttaccgttgccgacagccaaaaaaaacacgcgccgttttggggcgtggtcgcgcaaatcctgatactggatgccgtgttttccatcgattcggtcattactgcggtggcgatggtcgatcatatcgtcgtggcgatgggtgcggtcgtcgtcgcgatggctgtaatgatttctgccagcaaactcttgaccgaatttgtcgacagacaccctaccgtcgtgatgctctgccttggttttttgttgatgatcggtttcagcctgattgccgaagccttccatttccacattcccaaaggctacctctacgccgccatcggcttctcgattttaatcgaattgtttaaccagatttcgcagcgcaacagccgcaaaaacgactacatcggcagctcgtggcgcaagcgcaccgccgaaaacgtcttgggtatgatgggtatacgcgaaagcgtgcttgccgacgcgggcggcgaatccggggacgacgcgcattttgaagaaaacgaaaaatcgatgatacgcagcgtgctgacgcttgccgaacgcccgattatgggggtgatgatcccacgccgcgacatcgaacggctggacatttcccaaagccgcgaagaacagtgtgcccaactgcaaaacacgccttacagccgcctgctcgttgtcggtaaggcgggcgtggacgaacctttgggctacatcaacaaaaaagacctgctgtcccaactgctggaaacaggcggtctcgacattcagacggcattgcgccagccgctcgtcctgcccgacagcaccaccgcgctgggcgcaatcgaactcttccgccaaagcagcgcggattatgctttggtggtggacgagttcggcgcggtattgggcatggtaaccatgaaagacctgctcgaaaccatcgcaggcgagttccccgaagaatttgagcgcgaagaagaaccagccgttcaggggaatcccgatgaaagcctgacggtggaaggcgcgttggaatatgtggaactcgcaccgcaactcaacctgccgcagcaggaggaagatgccgatttccatacggttgccgggctgattatggaagaattgcaaaccatccccgatgtcggcgattttgccgatttccacggctggcggtttgaagtggtcgaaaaagaagggcagcgcatcgagcgggtcaaaatcaccaaattgcccgaagaataagcattcaggatagaaaatgaacgttttgatttccaacgacgacggctacctctccgaaggcattgccgttttggcgcgcgttacggcggaatttgccaacgtcagggtggtcgcgcccgaacgcgacaggagcggggtcagcaattcgctgacgctggaacgccctttgcagttgaaacaggcgcaaaacgggttctactatgtcaacggcacgccgaccgactgcatccacatcgggcagtctgtattttcggattttcaggccgattttgtcttttcgggcatcaaccggggcgcgaatatgggggacgacacgctttattcggggacggttgcggcggcaaccgaagcctaccttatgggcatacccgccgtggcgttttccttaaacgacgcttccggacgctattgggcgaccgcagaacaggcactgtggacattgttggcgcattttttcaaaaaccccccgcagtcccctattttgtggaacatcaatatccccgccgttgcgccggaagatgtgcggggcattaaaatcgcccgtttgggcaggaggcatcacggtcagaacgtcattcccgcgcgcaatccgcgcggcgaacagatttattggataggaccggtcggcgaagtttccgatcgggaagagggaacggatttcggtgaatgcggcgcaggtttcattaccgtaacgccgctgcaaatcgacctgaccgcctatccggacatggcggaaacagcggcgttctggcatgcggactgaccgtttcatcaaatatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatcc

SEQ ID NO: 37819 - DNA, 19211 bp, Neisseria meningitidis
ccgacatggaaaccatcaccatccctaaagaaaatttcgacgctttgctaaatctcgcaagaaccgccgtcgccctgaacgaaaattttattccaaaaataaattacggagcatccaccataccagcagccggctttgccgcacttaacgagtttggaatagcccgctccaccgtggaatctttggaaattctcaaaattaaataacctcctcggtattgtcatcccgtgataccggcaacctaactaacctctctttaaaggaaaatcaaaaatggaaacccaagaaaagaaatttgttcctgcctccaagcaaataccgaccgtaaatagcggctggttagaccgtgaattaggcgaagccatgagtgaagcggtgcgtgcctgccttgctcacggtaaacagtcagaaattactgtcaagctcaaaatccaaccccaaaacatccaaagcggaacggtaaaaatcagccacgatgtagcaaccaaactgcccaaagaaaaacgcgaaggcggcatcgtctttgctacacctgacggcaacatccaagccgacgatccggcacaaggaaaattgaaactcaaacaagtttccaatacgtcaagcacgttgaaaatggtcagatccaactaactcaaacacaaaaggaaatctaaaatggaaacccaagaaaacatgattaaaaccgccttacaagcagctcaaaaacctttttttgagtttgcaccgaacaatactccgcttgtattcacaccagaccaagacggtggctggagatacaaatcacaccccgaattgatgcaaaacccgtaccgcaagtgcggcaaattcctcatgcacgataccgccagtcttattaagtttgtacaaaaacacaaacaggacggcacacaaatctacattgatgccgatttcaaatcagggcgtattgatgtcaccgccgtcatcaatggccatacgcaacaagctccgggctggctcgatttttatgccgtatacaccccgcaacacactacatcggcatccaactggctgaacaacaatgcgcaccgcatgaatcagatggagttttcccatttcctgaccaacaatgcccgcaacatcgtatccaaaaatcccggtaacgaaaattccgtttacccgaccgccgccgaagtattggatttcgcgctcaatctcgagtacaccgaaaaaaccaccttcaaacaaggctatcgtgaacaggacggcagaatcaactttaccttccaatccgaagactcagggcaaacagagaaaaacctcaaaatgtttgaacgtttcggcatcgagttcaccccgcatcaaggcggtgcatcctactttgttgaagccctgttgaaattccgcatcgacaaaaacagcggcgcactcgtcctgtggtacgaattgcagcaaatcgatgctgtaatcgaacaagcggcaaaagacatttccgaagccgtacaaaaagccttccctgaaatcgacatctatttcggcgtaatcgcctaaaaaaaagtcgtctgaaatcgtgaaccttcagacgacctccacaaaaacccaaatccgaaagaccccaaaatgaccatcacagaagaatactccatcgacatccgagtaacctcagaacaggggaaaaacgactacggctaccccaccgaacgctacggatgcgacatcatcaacacagacggggagctacttgtcggcatagagccagagtacaaaaccccctttgccgccgtcagaaaggcgctcatctgtctgacaaaagacaacctcaaaaacgctgcctgatattaagccgttaccccaataatgaggaatcaaaatgaaatacttgatccgcaccgccttactcgcagtcgcagccgccggcatctacgcctgccaaccgcaatccgaagccgcagtgcaagtcaaggctgaaaacagcctgaccgctatgcgcttagccgtcgccgacaaacaggcagagattgacgggttgaacgcccaaatcgacgccgaaatcagacaacgcgaagccgaagaattgaaagactaccgatggatacacggcgacgcggaagtgccggagctggaaaaatgaactttcaggaagaaaacgagaacatcaagaatgacatagagattaatctcttgcattccgctgaagccgacagcgtggaggcaatgatggacttggcggtttacgggctggcggcgatggttgccaaacacaacaaaacgcgcggcgagcagcttgtgttacaggcgattgccggtcatatgcggaagcttttggccgcgcttcccgaaaccgagtcattggtgcagaccgggaaggtttaccgccgacttgaagatttgatttttaaaacgtatttgccggagcagtaaagatgaacacgaatcaagatacgattccatttggcggcaaccttgtgatttgctgttcgacgggaaacggcggggacgggcggttttcttgtctgattaccgatcagataccggatttaaatcttgtcagaagcgggcaggcgttcccgatgttcatttatgagtacgaaactagagaaaaaaggaaagcctgatggacaccctattaaaaatcatcatcgcgctgtcattttccggcgctgaggcattggcggtatggcttttcatcacggccgccgatgccgtattacgccgcttccagaaaccgagtcattacaggagagtaaaaaaatgaacatcaacgaactgggcgcaaggatagaccgcccgaccatccgcgaactgattgcctacgcaacctgccgcaaccgccccatttcaaactcgacactgctgcgtatggaaaaagacggacggataccgtgccgtctgaaaaccccactcacatcccccgtatgggacacccgcgaagttttggaagccctggggttacagcaataaaaaaacgcccgattagggcgttttcacattcagacggcttttgtattccctactgcatcaaaccgacgacaggttgcggatttcgggcagcatcgggcggatttttgccgcgtgttccgcgtcggcgtgtgcgtttaaggcttcgagggcgtttgcggcggctttgaggcggctgcgtgtttccgcccagaccgtccacatcgttaccgcctgtttgcagccgagctgcttcagcggcagggaaacgtctctgcccatttggatggcccacgcgccgtatctgacggcaacggcgaggtcgtacagggcgttgccgctgatgggcagggcaggttgcggtgcgggcaatggttcgcggtcgaggacttcgccgtacagcacgccgttttcaactgccacgcggcccatcacgcttaaaacttcggggaactgttcggcaggtacttctttgtagctgcatccgaacttgcttttgacggcagaccaaagggtaatggcgatacgcgcctgcgcttctttgggtgcggatttggtcagggcgttgtgcagttttttgacggcttcgatttgttcgccggtcaagccgtccggaagggcgcgggtgggtttgggggtaactgtttttatgccgtctgaaattttgccgttaagtaaaatttcaatctgctcatcgcaccaaaccgcaaatttcggattaagccaacgggcaaagtgaatagcgagtttgggatgcagccatgtgccttgctcactgccaccacgcttcacgataactatttgatttgcttccgttaggatttttctcctaacgcttaaattctcagcaagtgcagagatatattgttgagtttgttcactttttaggtagtctttaggtaacttgccaaagtgagatgcaatggcggttgcatttaaaaaaccgtcttgacggaaagatacaggggtgttaccaaaattgagaacagatacgttcatgatagtttcctagtttagtttcgaaagacccaaatgggtggtcgggaggttcgaaaacctactagaaaaggccggcgttattccccttgcgggtattgtattccgcaccctcccgaccataggaaactagttcggatatatcgaaacaaacaaccaaacaagaaaacttatggacgtaaaaaattcacgctgacggggtaaatgccgttctagtagaggttttcgacgcctcgtgtttcgtaatatatccaatctttctattttctgcaagcataaaaaagccgccatgtggcggatagggtcgcggtcttcaacagcatgtaggatttaggaatgcccaaattgggcgcaggggtgttgaaaacacgcaaacaggcgcgccgccagccttacgggtaggcgcacccccacataggagtaaatcgatttgatacgtatagacgtaaaaaattccactctatcgtgttggatatacgctgtttgtcaggtgttttcaagcaccgtgggaaatattatatagagttatggaaatgtgtcaagagaattagcccaaatgggcggacacgcggttaagaacccacataggagggcggacttattcccctttcgggtcttgtattcgtcgcccacgcggtcatagaaacttcctgctatcgaaacaaacaacaaggaaagaaaactatagacatgaaaaaatcacattgacggagtgattgccgctgtagtgtggtttctgacgccacgaacaggaatataaaacaaaaccccctgcacatgcaaggggtttcccaaaaaaccgtaggcggcaaactgaaaggccgtctgaatttcagacggcctatgttgcggcggatgttaagctattaagctatttggttttcagaggctttttcttccattttcgggctacggcttcaaattcttgaaaggccgtcggtgcgctcctgatacggcgtatttcaaaaataaagctgcttaggttgtcccagtcacgtaacagcatggagtattcgaaatctttatacattttctcgtgcagtgctccgcctaatacgcccgcacagacaaattcgcgctggtttaaaactgtcagtatggcttcacggtctttcttcttgtccggggtatccgatgtataggtggcgagtatgcatccgtctgtttttgccagcccgtttactatggttatggcttcttgaagggcggcattgttacgttcggccatgatcagcgcgctttttggcgttttctgtattcctcatgatgccgtaagcggcaacaaaaacgccgataacagtcaatatcggcgttgctatctgtattaggttgtcagtcattgccgtcccagccgtctgaaaggcggaaatcacggctttccgaataaatatgtcccattgtcatccccttaagctgatgttgaaaataaatccttgcgtcggaatatacggcattgcttgactattttcaagattctgtacctcgtgaaccggactatacaaaaaaaccgccttcgtgtaaagcggttcttaaatcgcccgttaaggcggacacaacgatagccaaactggaacaggaggcggcaaaggcgggtttgtccaaaacagccttgattgaaaggctgattggggatttgtaggcgtttgcagatacgacaaggggcgcattccgcgccccatcacacgcacggacggcttgtcatcgcctgtcgcccgtgcgcggctgcccatatttcagaacagtcttgcaagcccctttaagggaacggttttattctagtacagtttgaatgccttggcaacggctgttttaatcgcctgaaaatcctcttcactgattattggaatgcagcggtcgcgccctttgggtttgtatcggtctaatcgtgccaatccgactgttgccgtcatgtcgcattttgcccaacattggatgtgcggcttgtccggtaaggggtttccactcattttgtggtggtagtccgccaaagggacaggttctgtgctgcttaagggtacgaccgttaccagtttgccgttgtgcctgtttcgcgctatgacgacgacagggcgtttcttgaccatttccggttcttcataaccgcgaaagtcgcacatgataaccgaacgttcccttggttggaattttaaaggcattagccgctcctgacgatgacgggctgctattatagcagttcttacacaaaaaaccgcctttgtgtaaagcggttgcaaaaaagccttccaataaaaatgcggaaacggttttttatttgcgtttccgcataatactatccaccttcagaacctcgcgcaaataagtacgcgcaagcgagcgcaaaccgtgcgccgtcgtatccagccccgcccgctgcatcgccacgcgcggactttccttattgatatgcccttgaaaattcacactttcaaacacaaaccgcccgttcacattcaacgcccgcgcctgatccaacacccactgcatcgcccgcgacagcggcacatcatgcccccgccgctcctttttccgttcggcggggatacgccaaacctccccgtccaactccgaccactccatcaacgccgcctcctgaatccgcgtcattgtcaacagcagccaatagatacaaagccgcgttacaggatggatacgcaccctgcccgcataaaccgcaaattcattgcgctgctccaaaaaatcaatcaggcgcggcaattcagacggactcaacgctgccatattccccgttttcgcccgttcaaacacacccgaaccgatttgcgcgacagggttgatttccatcattcccgaaccgaccgcaaacgcaaacaccatcttcagactgtttttcgttttgcgcaacgtatcaacgataccgcgcgcctccatcacacgcagacagccgaccacatccgccgtcctgatttgacgaatatcaagattgccgatagccggaaaaacccaccgctcaaaattccgcataacctgtccggcatacttttcagaccgccccttcgaccaacgcacaaaccaatcacgcgccaccttctcaaaagcaaaatccgcccgcaccttcttattgacgacattttccccgtgcgcccgttttcggcgcacctcctcccgccattcccgcgcatcggccagcgaaaaatcaggataccgccccagcgaaattgtctgctgccttccatcctgcacaaacgacagcttccaactccgcccgcccgtcgggtagacccacaaagccagcccgccccgtctgacaacttatacagcttatcgcgcggcttcgcatttttaacctgatttgccgacagcggcgtaatgattttcgccattatggtaatttcccatttatccaaaaattaccatacacattaccataaaaaaatgcaataagaagatgccgcaagattgcaaatgatttgctttgatgcgttatgatagggcaaaccgatgatttttatatggtaattgatacaacttgaacaaaaaagaaccgccccgaatcagggcggttttgttttgtggcggaaacggtgggattcgaacccacggaggatttgcaccctcagcggatttcgagtccgctgcattcagcctctctgccacgtttccgataatgcagtaaaaccaaataaaaatacaatatttgcggctattgcattcttatttggttttacgctcaaaaattggcggaagcggtgagattcgaactcacggagggctatcaaccctcgacggttttcaagaccgttgcattaaaccactctgccacgcttccgtcttcttgaagattaggaataataatgaaatttatacattttgccaagcacttttttcggaaaatacttaatttattgttttcactttatttgttccgaacgcataaaaacccattcgctttcatttgaagccgcgtcattgaatgcgtagccttcgtaattaaaatttttcagcatttcagggtcggtaatatgatgttctgccgcatagcgcaccattaatccacgcgcgcgcttggcatagaaactgatgattttatatttaccgtttttttcgtctttaaatattggggtaatcagccgcgcccgaagttttttcgtgttgacggacttgaaatattcctgtgaggcaaggttgacaagcgtattgctgcctgcttgggcaagcgtatcatttaaaaggttggtaatgatgtcgccccaaaactcatacaaattcttgccgcgcaaattggcaaatgccgtccccatttccaaacgatagggctgtatcaggtctaacgggcgaagaagaccgtacagaccggacagcaggcggacatggttttgcagatagcgtatctgtccaatatccaatgtgtttgcatccataccttcgtaaacatcgccgttgaacataaagaccgcctgtttggcgttttccggcgtaaacggcgtgttccattctgcattgcgctgcgcgtttaagagggcaattttgtcggaaacgtgcatcagttcggcaatctgttgcggcgcaagctcgcgcaactgctgcattagaatgtcggactctgccagcaggtcgggttgggtaaactcgctgacaggggcagggtctttttcattaaggttcttcgcaggggaaaggacaaaaaacataatctgctcggtattgtgtcaaacacggggattttaagtttaaacgtgtttgcgggcaagccgattaaaagtgaagtatagtggattaaatttaaaccagtacagcgttgcctcgccttgccgtactatctgtactgtcttcggcttcgtcgccttgtcctgatttttgttaatccactataaataccgttatagcaaattcaaccgtaaaatattgaaaaatgccgtctgaacaaaagttcagacggcatttttttattctttaccgatatagggaaacaatggtttccgcagctttgacacaagttgcgacatcggcaaccaaagcgatacgcacataaccttccccgggattgccctgttcggtatcccgcgccaaaaaacgtccgggcaatacttggatagccgctttttgccataaattgcgtgcaagtgccaaatcgtcgccatcagggactttcaaccagatgtaaaacgaggcatccggtaatttaacgtcaaatacctgttgcaaaatgggaataacgcgctcaaatttttcctgatacatacggcggttgtcgataacgtgctgttcatcatcccaagcggcaatgcttgcgcgctgcacgggaatactcattgcactgccgtgataggttctgtaaagcagaaagtttttaagcagttcggcatcgccggcgacaaaaccggaacgcaggcccggaacgttggaacgcttggacaaactggtgaacataagcagtttttgcctgcttcgacccaactgtgcagcggcttgcaggcagcccaaaggtttgttgccgtcgaaatagatttcggaatagcattcatccgaggcaataatgaaaccatatttatcctgtaaatcaaaaacttctttccagccgtccaaatccagcacgctgccgctggggttgttgggcgagcagacgaacaccagtttggtgcgtttccaaacctcttcggaaatactgcgccaatcggggttgaaagacggcgcggggcaattggcaaaatggatttcaccgccgcccaaaagtgtcgcaccttcgtaaatctgataaaagggattcgggctgacaattgcgggtttgatgccgtctgaaacagggttcaacacggtttgaacaaaagaaaacaacgcctccctactgcctaaaaccggcagaatttcattatccgcatccactgtcaagccatcgtaacggcgttttaaccagtttgcacacgcctgacgcagttcaggcagaccggccgtcagcggatatttttccaactcgtgcaatgaggcggtcagcgcatccgtaatgactttcggtgtcggatgtttcggttcgccaatgtgcagggggacggcttccagaccttcgggcgcggaaatgccctgcatcgcttcacgcagtcgggcaaagggatatggtttgagttggttgagtaaggtattcatgattttctccggttgtcggtatatcggaagatatgccgtctgaacctgacgtgtctttcagacggcattctatatttttagtgagaacccgtactgccgaagccgccctcaccccggctgcttccgacaaactcctcgacacgtttgaagcccgcctgcacgattggcacgacaaccatctgcgcgatacgctcaaacggtttgacagtaaacggttcgctgcttctgttccataacgacaccttcaattccccttgataatcggagtcaatcaaaccgaccaaattgcccaaaacaatgccgtgtttatgccccaagccggaacggggcagcaaaacggcggcatatgcgggattcgccaaataaattgccaaacccgtcggcacaagaaacgtttcacccggctgcaaaacgacttcctcatccaaacaggcgcgcaaatctaaacctgcagaaccctccgttgcatagacagggacaacatccgccatccgttcgtccaatactttcatttctacttcaatattcatcgtcttgctcctgcatacggccggtttcaaagatgggagattatacacaagccgtgtttacgctgaaacacggcaaatcggttttgttttgaaatccgttgccagtgtataattcccgcccttccggttatgaagacgaacattatgcacaccttccccgcataacgaatttatacgcggcatcaaagaaagttcgcctatgctgattgggctgctgccttgggcattaatactcggtatgcagggcggacaaaaaggcatgagctggctggaaatgttgttgatgaccagtatgaacttcgccggcggctccgagtttgccacggtcaacctgtgggcggaacctctgccgatactgcttatcgccaccgtaacctttatgattaattctcggcatatcctgatgggggcggcgcttgccccgcacctgaaaggaataccgctgaaaaaagccgtgcccgcactgttttttatgtgtgatgaaagctgggcgatggcattctccgaaatccaaaaacggaaagcagccggtttgcccgcattcaatatgcctttttatagtggattaacaaaaaccagtacagcgttgcctcgccttagctcaaagaaaacgattctctaaggtgctgaagcaccaagtgaatcgattccgtactatctgtactgtctgcagcttcgccgccttgtcctgatttttgttaatccactatatgaatcgtcattcccgcgcaggcgggaatctagacattcaatgctaaggcaatttatcgggaatgactgaaactcaaaaaactagattcccactttcgtgggaatgacggcggagcggtttctgctttttccaataaatgccccccaaactaaaatccgtcattcccgcgcaggcgggaatctagacattcaatgctaaggcaatttattgaaaatgactgaaactcaaaaaactggattcccactttcgtgggaatgacgtggtgcaggtttccgtatggatggattcgtcattcccgcgcaggcgggaatctagacattcaatactaaggcaatttattgaaaatgactgaaactcaaaaaactggattcccactttcgtgggaatgacgcggtgcaggtttccgtacggataggttcgtcattcccgcgcaggcgggaatctagacattcaatgctaaggcaatttatcgggaatgactgaaactcaaaaaactggattcccactttcgtgggaatgacggcggagcggtttctgctttttccaataaatgaccccaacctaaaatccgtcattcccgcgcaggcgggaatctagtccgttcggtttcggtttttttggctagtgccgcaacattaaatttctagattcccactttcctgggaatgacggcggagcggtttctgcttttcccaataaatgaccccaacctaaaatccgtcattcccgcgcaggcgggaatctagacattcaatgctaaggcaatttatcggaaatgactgaaactcaaaaaactagattcccactttcgtgggaatgacgggatgcaggttcgtgggaatgacgtgatgcaggtttccgtatggatggattcgtcattcccgcgcaggcgggaatctagtccgttcggtttcggtttttttggctagtgccgcaacattaaatttctagattcccactttcgtgggaatgacggcggagcggtttctgcttttcccaataaatgaccccaacctaaaatccgtcattcccgcgcaggcgggaatctagacattcaatgctaaggcaatttatcggaaatgactgaaactcaaaaaactagattcccactttcgtgggaatgacgggatgcaggtttccgtacggataggttcgtcattcccgcgcaggcgggaatctagacattcaatgctaaggcaatttatcggaaatgactgaaactcaaaaaactagattcccactttcgtgggaatgacgggatgcaggttcgtgggaatgacgtggtgcaggtttccgtacggatggattcgtcattcccgcgcaggcgggaatctagacctgtcggtttcggtttttttggctagtgccgcaacattaaatttctagattcccactttcgtgggaatgacgggatgtatagtggattaacaaaaaccagtacggcgttgcctcgccttagctcaaagagaacgattctctaaggtgctgaagcaccaagtgaatcggttccgtactatctgtactgtctgcggcttcgtcgccttgtcccgatttttgttaatccactatacccataaaaataccgtctgaacattgattttcagacggtattggcaaaacaaccttattttttacgattagagaaggcttcacagccgacatctgaggacaaggtctccaaatgggcttgggcagaagcggcatcacggcatttgtatccgtcgcccacgctgttcatccataccgacaaagtataacccgtccccgccttcggaacgccgaccaacctgtatgcccttgatttttccttatcgacaaactttaccgaaacactatattttttggcaattttcggattcatcttatagcctgagacaaatatttccagtttgttctcgatggtctgattatcgtccaggggatttttcaaaataaactgtttggaaatattgttgataccgaccatctccgtataaagctgggactgatagcctttttcaatataactttgataagaaggtatggcaatgacgctgataatgccgagtatcgcgacgactatcatcatctcaatcaatgtaaaccctttttgttccattttattactcatcattattgcttacataagattgaaggacgaccacggtattggcattcttaccccaagccttggcagtaacccgataaacattttctccgttcttcacgcccaaatattcgataatataacgtggcattttgctgacgcttctcgtgcctttcttatattccatccctttcttgtcaatgcacaggtcggtagaatttgcagggcaagaacgcttcaccgcctcaacggtgggcttgccttgcaccacgatattgtcaaaagcctcttcattatcattatttgtccgcacattcactgcggcacacagaccttttccacagttttcgctaaatgtaaccttactgtccgtatcatattccaaatccaaaacctgaagttcgccttcccgcaaagccgcctcggccaaagacaaagccaatttcctgtctgattcgttggcactgatccgctgctcggtattgtaagactgcgcggcagttacaaccaaaaaagccacgacgatcatcaccatcagcacgataaacagtgcaaaccccctctgtccgtcagaagtcgggattcccgtcaaagtgttctgtttgcgcatacatttcccccgcgtattgtcgcatcgatacggtaagcataaatatgattgtctgaagaagcggcaatcttggtatcagtaccgctactcaataaaacctccaccccggcgggcgtaacagcattttgggcgctgtcgaatttatccgtatatttgaatgtttcctctttgccggcatcgtcatcttcaggacagccggaaacatagatataccgcactttcatatgtctaacctttttcacgagcaactgaggattaccccacttgcccttatcatccaattggaagcggaacaaaccttcctcatcggcaatcctgccgaccgcataggcattgaccacatgcctttgacgcgctatattgccattttgctccttatcctgatccggaatcttcaattctttttttgcatcttctaaagtagggatttgcttgcccggtttcgatattgcggcacagctgctgacgacggtagtcgcggtgcttgcattaacatcatcgattccgtattgaaaaatcaatgcgctaccaacctggaaaaaattctgataattgatatttgaagattccgctatgggaataagtttatctataccgttcctttttaaggaaaaaggagaattttgttgcgtcgtatcgggaataacatcagttgcaggatgctcggacatattgaaacaaccgaagccgcctgccattctcgcatcgcggacaatcaatgttgccgcattccgcaaatcctgttgcgcggcaagacgctcgtttgccgcatcatttaatttccgggatgtgaagtaactcgatccgaccgccatcaggacaatcatactgagcaggcccgcaaccaaaaattcaataatggtaaaacctttcataccatcataactgccttttggtacgtttagcattttacgtctcattcccgacctccgacccttgcctgataagtatatacgatattgtcgccgctcacctcaagattcgtacgggaaatatccgaatcccctgccgaatcatttacccacaatactttaattaaagtatccccgtttgccttattgtcgcaatttgaagaaaaagcattgccggacaatgtcggcgcgttacccgacgaatccttgcagacggcgtaatggatggctgccgcatccggcaaggcatttttcagctcataactaaatctcttcaattgtgcctctgccaattgccccttagttttcatggcatcaatcgcaaaatcgccatccacagctgatagtgtatggtttcccatgtaaagattatagtttttcttgttgctgtccgaatcaatggtcggattcatcaacattccctccatcaggttttgcgtgatttggctgacgatggtttgtgtctccgcctccctgacggaagcgactgtccgcaactgtacagacaatagtgccaaaataccgatggtcagaacgagcatagcaaccaagacttctatcagcgccataccggactgggaatctttcaggcggaagcaatcattattcttcatattcatttttaaaactgaaactgttatttatactggcacatagtacgccgatcacccctagggcaaacttcgaccctgccgctgctgttaatcaaaaccaccgccgaacggaatttcttttcatcggcagaaaccgccttcgcatctgtcaacacgatttggatataaccgtcagaataaaaaaagctggattgttttgtaagatgctggtctttcgtataaccgaacgtcccgttttgattgaatgtccaaactacacggtcggtggtcggctgagtctgaccgaaagcgatatggttgaaggcataattaatccgcttatcattgatatcatcattcaataccacactgcggagaagaacatcctccgtatcattgtcatatcccttattgccgtttttgtcgccgaaagccaacattccctgccccttcttgccggagtcacatttattgttgggcgtaccgtcttttttaacttgaacaggacagatatagacagggagattgagccggacggcttcgcccctggagaaacgcaaaaggttggcaatccgctccgcgtgactggcaatgcggcgggatgcaatccattggctcatattggggagggctatcatcgccataatggctgcaatgaccatcacgatgagcagctctgttagcgtgaaaccttgttgttttcgtgtacacataagcaatagaacgttaactggtaatgtatcgtggattaaattcaaaccagtacggcgttgcctcgccttagctcaaagagaacgattctctaaggtgctcaagcaccaagtgaatcggttccgtactatttgtacggtctgcggcttcgttgccttgtcctgatttttgttaatccactatattttcaattatatgcgggctgaatgcaaaaatgcctcaagaccgcgttttattttttagggcaatctctcagcatgattttaaacgattttgcctgatttcgcctaataaatttttatatagccatttaatcctctatctttgcctcctcgggaatataggcagcattgtcgaatttggtgaattgtcccgtccatgtgaggaagattttaccgacgggaccgttgcggtgtttgccgatgatacattcggcaaggcctttcatgggtgagtcctggttgtagtattcgtcgcggtacatgaacataatcaggtcggcatcctgctcgattgcgccggactcgcgaaggtcggacatcatggggcgtttgtcggtacgcgattcgaccgtgcggctcaattgcgacagggcgatgatggggacttgcaattctttcgccaacgctttgagcgaacgtgaaatctctcccagctccgaagctcggttgtcggaacggccggatcctgccatcagttgcaggtagtcgatgacaatcaatccaagcttattgttaaattgacgggcgagacggcgggcacgggcgcgcagttcgagcgcggtcagacccggggtctcgtcgatgtacacgggcgcgtcggagagtttgacgactgcttcgttcaggcgaccccagtgttcgtcttcgagcctgccggttttcaaaacgctttgatccaaccgtccgaccgagccgagcatacgcatgaccagttgcgccccgcccatttccatcgagaaaacagcaacgggcagcctgccttctacggcaacgtgttcggcgatattgatagaaaaggcggtcttacccatagacggacgaccggcaacgataatcaggtcgccgggttgcagacccgaggtttttttgtcgaggtcgatgaaccccgtcggcacgccggtaacttcatcgggattgtcgcgcgagtagagcatatcgatgcgctgtacgacttctttcagcaaatcgggcatctccaaaaagccctgcttggatttggcggtgctttcggcgatttggaatactttgttttccgcctcgtccaaaagctgccccgcgtccctgccttgcggattgtatgcgctgcgggcgatttccgtccccacttcggcgagttggcgcataatggaacgctcgcgcacgatttcggcgtagcggcggatgttggcggcagacggggtgttttgcgccagcgtaatcagatattcgaatccgcctgccgcttccaattcttcgttccgctgcaaatcttcctgaaccgtaatcacatcggcgggacggctctcattaatcaatttggcaatggatcggaaaatcaggcggtgttcatgccggtagaagtcttcaccggaaaccacatcggcaatcctgtcccatgccggattttccagcatcaacccacccaaaacggattgttccgcctccattgagtgtgggggcagagacaatgcgccgacctcacggtcttcagacggcatggctgcgtaatcgttcatggtacatcctatctgtcgtgccgaaattgcaatcttctattatagcgtaaagcaggtttaattggtttccgcaccgcaaaacaggtagaatacacgggctgccgagttatttgcagcaacactgccaaaatacaacatttaaaacaatattcaggagtacaaaatggaacataagctgccgcaactgccttatgaactggacgcattgtccccgcatctgagcaaagagactttggagttccactacggcaaacaccatcaaacctacatcaccaacctgaacaatcaaatcaaaggcaccgaatttgaaaacctgcctttggaagagattgtgaaaaaatcttcaggcggcgtgttcaacaacgcggcacaaacttggaaccacaccttctactggctgggtttcacgtccaaaggtcaaggcaaacctgccggcgaactggccgccgccatcgacgcgaaatggggcagcttcgagaaattccaagaagcgttcaatgcctgcgcggccggtactttcggctccggttgggcgtggctggtaaaaacccctgccggcggattggatttggtttctacttccaacgccgctacgccgctgaccactgaaaacacgccgctgctgacctgcgacgtgtgggaacacgcctattacatcgactaccgcaacagccgtcccaactacctgaaaggtttttgggaaatcgtcaactgggacgaagtcgccaaacgttttgccgccttgtcctgatttttgttaatccgctatatcatttcgggtagatttttgcggtattgaatttcagttatttccgataaatgcctgttgctttttatttctagattcccactttcgtgggaatgacggttcagttgctacggttactgtcaggtttcgattatgttggaatttcgggaaacttatgaatcgtcattcccgcgcaggcgggaatctagaccttagaacaacagcaatattcaaagattatctgaaagtccgagattctagattcccgctttcgcgggaatgacggaaagtggcgggaatgacgggatgtaggttttcttaaccctgcgtcctagattcccgcttttgcgggaatgacggaaagtggcgggaatgacggttcgggcattccttaaattacccgtgtatcgctgtaaatcttagagatggcggaatatagcggattaacaaaaaccagtacggcaaggcgaggcaacgccgtactggtttttgttaatccgctataattgatgaaacgggttaaaaaagtgttgccatcgcctgttcttcttgtcggatacgcttaaataagaccagcaaataaatgggcaggccaatcaa

SEQ ID NO: 37820 - DNA, 546 bp, Neisseria meningitidis
  misc_feature (1)..(546): N is any nucleotide
tgacccggcattcccttcctgcctgcgttcgtggacgcttttttcaaattccgattccgccgtttcgtttttcgggaacacgatttcgccgcgaagatgagaaaacaaacgtttcacaaggttttcgtccacggcgaacaattcggtatcgcctatcctgcttttgctgaaaatttcatggagcaggttttctttttctttgtaattgtcggttttgacggcgaggatgcgttccaatccggcaacgttcgcataaccgttgttttccaaatggcgcattctgccttcaaaattgcttacatccgaaatgccgattttatacacgcccttgatgacggttttnatcagatagacaatgcctgacttttccatatcgatgtttttcaagtgttttcgagccttcagacggcatcggattatttctatgccgtctgaaaccgtttaagtatcaaatattatcgacactctggcctgtnagcgcgcgttggatgttgcggttcatgcgtttggcggcgaaattntcggtgatgctgccgagtttggcgg

SEQ ID NO: 37821 - DNA, 662 bp, Neisseria meningitidis
ccgcactgatttcgcaaatcggtacatatatcatcagcgcgggcggcaaacgcctgcgtccgattatgacgattttggcgggtaaggcggtcggttatgatgacgagaaactgtattcgctggcggcgatggtcgagtttatccacacttccaccctcctgcacgacgatgtcgtcgatgaaagcgatttgcgccgtgggcgggcaacggcaaacaatctgttcggcaatgcggcggctgtgttggttggcgactttttatacacgcgcgcctttcaactgatggttgcctcgggcagtatgcgcgttttggaagtgatggcggatgcaaccaacattattgccgagggcgaagtcatgcagctgatgaacatcggcaatacggacattaccgaacgaacaatatatccaagtcatccaatataaaacggcaaaattgtttgaagctgccgctcaagtcggcgcaattttgggcaaggcttcccccgaacacgaacgggcgttgaaagactacggtatgtatgtccgtacggcattccaaattattgacgatgtgctggactattctggcgaaaccgacgaaacggcaaaaactcagcgacgatttggcggaaggaaaacgactttgcctttgatttatctgatgcgtcagggttccgaaca

SEQ ID NO: 37822 - DNA, 7959 bp, Neisseria meningitidis
ggctgctgcgaggaagatgtcgggggcgggtttggaatgtgcgacggcggcagggtcggcaatggcgtcgaagaagtgggtcagccccatgcgttccagcaggaacgggccgtttttactggcggacgcaagggcgatttttttgccgtttgccctcaatgcttccagcaggggcaaaatgccgggatacacgtcttcgggtttgactgcctgaatcatctcgacgtagttgtcgtttttacggcgggtcagttcggcgaactcggcttcgctgacggttttgccgccgtgcgcgaggatgcgtttgagcgaatcgtcgcgcgacacgcctttgagctgctcgttaaacttgcggtcaatgctgatgcccagttcttcggcgagctttttccatgcgcggtagtggtattcggcggtgtcggtgatgacgccgtcgaggtcaaataggactgcagtgaaagtcattttgcgccctccttatttttccaacgcaacggtgtggctgccgtcgagcgtgatgtctttgccgtacacctgcaaatcgagcgactcgcctttgagcagagtgaagacgacgttttctttgccgacggcgactttaatcagacggccgcggtagttgatgtggaaggcgtagcctgtccacgcactcggcaggaacggtgcgaagctgagtttgccgccccaggttttcatttgggcgaaaccttggacgatggcgagccacgagccggtcatggaggtgatgtgcaggccgtcttcggtgtcgttgttgtagttgtccaagtccaggcgggcggtgcgctggtacatttccacggctttttcttctttgcccagttcggcggcgagaatagagtgaatacagggcgacagcgagctttcatgcacggtcatcggttcgtagaagtcgaagttgcggcgtttttcgtcgatattgaaacggtcgctgaagaagtagatgccttgcaatacgtccgcctgtttgataaagggcgaacgcaggattttgtcccacgaccatttttggttgagcggcaaatcgtcgggcgaaagcgcggacacggggcggatgtctttgtcgaggaagccgtcgtgctgcacgaatacgccgagttcttcgtcatgcggacggtacatattcgcgctgatgtccgcccatttttccaactcgtcggcacgcacgttcaaatccggacgcgggtatttcgccaaggcttcgcgggtgtagtccaatacccatgcggcgagggtgttggtgtaccagttgttgttgatgttgttttcgtattcgttcggaccggttacgccgtgaatcatgtatttgccgttgcgtttggagaagtggacgcggtccgcccagaagcgggacacttcgaccaaaacttccaagccttctttggcaagatagccctcgtcgccggtgtagttggtgtagttgtagatggcgtaaggaatcgcgccgttgcggtggatttcctcgaaggtgatttcccattcgttgtggcactcgatgcccgtaaacgttaccatcggatagagtgcgcccgccaagccctgttcgcgcgcgttgtgctgcgcctgcggcagttggttgcggcggtattgcagcaggttgcgggtaacttcgggttcggccagtgcgaggtagagcggtacggcgtaggcttcggtgtcccaataggtcgcgccgccgtatttttcgccggtaaagcctttcgggccgatgttcagtcgcgcgtcttcgccgtagtaggtggagaacagttggaacaggttgaagcggatgccctgctgcgcttcgtcgctgccttcgatgaccacgtcggcgatttcccaacggtgcagccagcctgctttgtgcgcgtccagcaaggtttcaaacgcaacgcctgcaattttttccgacaaggcgcggcctgcggctttcactgcttccaagctctgataatcgcggctggtggtaacaatcacgcgtttttcaaaggtttcgggtgtgctgccgacttcggattcaaaagaattggagacctgccagtcggtttggctgccgccgagggctttgaagctgccggcaaaggtttgctcggcgttgacgatgaattgttccacgccgaagggattggcgacggtttgggcggcaatgtaggagagactgtctgaaacgcctttgtccaatacctgccagaatttttcttcgtagttggagtcttcgtttttcacgtcggcatcgatgatggaatcgatgcggacttggtgggttttaccgtcaacggatacggcttcccagcggatgaccgccagctctttttgtgcgacagacaggaatttgcacacattgaaacgcacaccgaatacggtgaacgagcggcgcaacacgccgtgctgcatatcgagttcgacggagaagccagcaacgtcgtttttcgccaagtccacttcctgcccgtcgacaaagattttgactttgctgaaattgaacgcgttgatggctttgccgaaatatttgggatagccgtttttccaccagccgacgcgggttttgtcggggaaccacacgccggcgatgtaggtgcctaagtggctgtcggcggaataggtttcctcaaagctgccgcgcatacccatatagccgttgcccaagctggtcaggctctcttgcagccgtttgtgttctttttccagttttgccgaacgcagcgtccaagggctgatttccatgattcttgtgtacatttatgaagctcctgtttggattgatttgagggaatggtgaaatcttatagtggattaacaaaaatcaggacaaggcgacgaagccgcagacagtacaaatagtacggaaccgattcacttggtgcttcagcaccttagagaatcgttctctttgagctaagccgaggcaacgccgtaccggtttttgttaatccactataaaaaggtcgtctgcaaccggtgttaggaagctcctaagaaagggattcgatgccgtaagcaatcgtcgcctccctggtatcacccttgttcagacgaatattgccgaactcgggccaattcaggctgtcgggcagcgtctgcgcctcggtcgccagcgcgtcgtaaacgcccgcatcgtgccgcgcgaaatcctgcggggcggcggtaaagatgaccaagccattgcggtcgctgtatatgctgatacgacggcggcgtccggcttgcaacacagcggcgggacggcctatatcggacggcacgcggtaagcgtcgtcaaaaccggcccgacccgtttcgcggcgcagggcggcaacggcggcatccagcggcttgggccggctgaaatcaaatacttcgaggtcgtctgaaaccgttgagacgggcagtttttcggcatcggccggcatatgtccgccctgcggaatatgcagaaccgcatcgtgcaggcccgcgtccagccgccagtaaatgtgcagcgtcgggtcgaacaccgtgtcgccgagcgcggtggcgcgatagctaacggtaagccggtcgtcctcgtccaagcggtaggaaatatccaaatccaaatcgttgggataaccgtcggccgactgttgcaggcggctgcgcagcaccaccgaacggccgtctgccgccaccgcgttgaaacgggtaacggccagcccgtgcgaaccgccgtgcagcgcgttcctgccttcgttggcctccacgcggtaagtcctgccgttgatgtcgaacgccgcaccgcggatgcgtccggccacgcgccctatctgtttgttaatctgaaacggattgtccgcataggaagccgcatcatcgaacgacaccacgaggttttcgcgcacgccgtctgccaaaacggaaaattcctgcacaatcccgcccaagtccagcacgcagacacgcgtaccacgccggttggacagcacatagccggttacggcacgcccgtcgatcagaccgaaatcgcgggtagcgggggtatcgctcatcgctcaaaccccgccgtgtgtttctttaatcaggaacacggaaaacgcgcccagcagcaggacgacgccccctaccaagaacatagtggcctgcaagccgcccagcatagggaaaagcacgaaactcaacagcgaagcgacgatttgaggcatacagatagagccgttaaacaagcccaagtaagtgcccatatgcttgcccgacaaggcgttggtcacaatcgtcagcggataagtgataatgcccgcccaagcgatgccgattaaggtataagacaacaccagcgcgtattggttgccgatgaagaaaacggagaaaaagccgagcgcgcccaaagccaaacagccgaaataacccgccttatggtatttattcggcactttcgccaatacaaacgaacaaatcaccgccgcaaccgactgcaccgccgccaaaacgccgtaccagttacccgcctcctgataacctacggaagacgcatcggtggtgtgccagacgttttccgcaatcgcgcctgccgagtaagtccacatatattggaaggcgaaccagcagaagaattgcaccaaagtaaccgtccaaaacgccttaggcgcggttttcaagagttcgatccagttggctttttcctgattcgcggcgacatcgatgccgtggtaacgggcgtaggtttccggatcgtattccttcactttgaaaatcgtgaacgcgctggtaatcaccagcaacgccgcacccacataaaacgccacgaccacggtctgcggcacaacgcctttctcggcggtgttcgccaaaccgatatacgcaaacacaaacggcagaatcgccgccacgaccgcgcccgtatttgctaagaaactttgaatcccgtaggcgtagcctttctgctcctcgttgaccatgtcgccgaccatcatcttaaacggctgcatcgccatatttgacgacacgtctaacagcgcaatcatcagcgcgccgaacgacaaagccgccagcgacgcatagccgaaaccgaagctgcccgagttcggcatcaaaatcatcacaataaccgcaatcagcgtgccataaagcagatacggcagacggcggccgcccaaacgcggcttccaagtgcggtcggagtaatggccgacaatcggctgcaccagcatccccgccagcggcggcaggatgaaaaaccagcccaaattgtgcgggtctgcgcctagcgtttgaaaaatgcggctcatttgcgagctttgcagggtaaaggccgtctgaacgccgagaaagccgaaactgagcatccaaatcgtgctttttgccagcgcgggcaaaccttgttttgctgtttgaggcgtatattccgacataaggtaaatccttttttgatttgaaaagtatagtagattaacaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatatttgctttggaaaatccgaaatggttgccggggcggcgatcccctatcattattatttttttgtctatataatttcaaagggataagcggattttatgaatcctgcccgattttggcaataccggttcgcggataaactggcttaaatcaaattatcggttaaaatggccgtctgaaatttgtttgatgaaaacgagaaaaccatgtcccaacaatacgtctattctatgctgcgcgtgagcaaggttgtgccgccgcagaaaaccatcattaaagatatttccctttctttcttccccggcgcgaaaatcggcctgctcggtttgaacggcgcgggcaagtccaccgtgctgcggattatggcgggcgtggataaggaatttgagggcgaagccgtgccgatgggcggcatcaaaatcggctacctgccgcaagagcctgagcttgatccggaaaaaaccgtgcgcgaggaagtggaaagcggtttgggcgaagtggctgccgcgcagaaacgtttggaagaagtgtatgccgagtacgccaatcctgatgcggattttgacgcgttggcagaagagcagggccgcttggaagcgattattgcggcaggttcgtccacgggcggcggtgcggaacacgaattggaaatcgccgccgacgcgctgcgcctgccggaatgggatgccaaaatcgataatttgtccggcggtgaaaaacgccgcgttgccttgtgcaaactcttgttgagcaagcccgatatgcttttgctggacgagccgaccaaccacttggatgcggaatcggtcgagtggctggagcaatttctcgtgcgcttccccggcacagtcgttgcggtaacgcacgaccgctacttcctcgacaacgccgccgaatggattttggaactcgaccgcggccatggtattccgtggaaaggcaattactcgtcttggctggagcagaaagaaaaacgcttggaaaacgaggcaaaatccgaagccgcgcgcgtgaaggcgatgaagcaggaattggaatgggtgcgccaaaatgccaaaggccgccaagccaagtccaaagcgcgtttggctcgttttgaagaaatgagcaactacgaataccaaaaacgcaatgaaacgcaggaaatctttattcccgttgccgagcgtttgggtaacgaagtgattgaatttgtaaatgtttccaaatcgttcggcgataaagtgctgattgacgatttgagcttcaaagtgcctgcgggcgcgattgtcggcatcatcggcccgaacggcgcgggtaaatctacgctgttcaaaatgatttcgggcaaagagcagcctgattccggcgaggtgaaaatcggacaaaccgtgaaaatgagcttgattgaccaaagccgcgaaggtttgcaaaacgacaaaaccgtgttcgacaacattgccgaaggccgcgacattttgcaggttggtcagtttgaaattcccgcccgccaatatttggggcgtttcaacttcaaaggcagcgaccaaagcaaaattgcaggtcaattgtctggcggcgaacgcggtcgtctgcacttggcaaaaaccttgttgagcggcggcaatgtattgctgctggatgaaccgtctaacgaccttgacgtggaaaccctgcgcgcgttggaagacgcattgttggaatttgccggcagcgtgatggtgatttcgcacgaccgttggttcctcgaccgcatcgccacgcatatcttggcgtgtgaaggcgactctaaatgggtgttcttcgacggcaactatcaggaatacgaagccgacaagaaacgccgtttgggcgaagaaggcgcgaaaccgaaacgcatcaaatacaaaccggtaacgcgttaacctccgaaacaatgccgtctgaaaggctttcaggcggcatttttacaaggcagcaccgtttaaaacagcattgcaatcctcaagacaatcaaagtcatcaccgcagccgccatatcgtccgccataatgcccaaaccgccgtgcagattcttgtcaaaccaaccgacgggagacggtttgagcgcgtcaaacagacggaataggacaaatgccgccagccaccacgtccacctgaacggcacaaacgccagcacaaacagcatggcgacaatctcgtcccaaacaatcccaccgtggtcgctgacacccgtttcacgttccgcataagcgcaaatgcgtatgccccacataaacagcacgatacacaaaaaagccagcagtagcccgtctatgccgagcaaaatcagcacaaacgccaaaggcagtgccgccaaagtgccgaatgtgcccggcgcgaacggagccagcccgctgccgaaaccgaaagccaaaaaacacaacggccgtttcaacagccacgcaaagtcaggtttaaaatcagccaaaatgatcgaatc

SEQ ID NO: 37823 - DNA, 567 bp, Neisseria meningitidis
  misc_feature (1)..(567): N is any nucleotide
cggtcttggcgcacgcgcgntctttcggcatacatcacgcccaaattgttttgggcttgggctaccccctgcgctgccgcctgccgaaaccatctgaccgcttcgacatcgtcttggcgcactccacgtccttcggcatatatcacgcccaaattgtattgggcttggacaaccccctgcgctgccgcctgccgataccatctgaccgcttcggtatcatcttggcgcacgcgcgcccgttggcatacatccagcccaaattgtattgggcttgggctaacccctgttccgccggctgccgataccatctgaccgcttcagcatcatcccggcgcacgcgcgtcctttgtaatacattgcgcccaaattgtattgggctgctgcatttccctgtgctgccgctgcaagttttcccgaaaatccgatacgtcatccgnccacaccggtcggttcaagcccaaggcaatcagggcggcggcaagcatttgactgtctgtttcatggtttnacttctgttttagtataaggcgggtttcagccaccgntaacgatagggctgggcggatt

SEQ ID NO: 37824 - DNA, 8093 bp, Neisseria meningitidis
gtaccctgctcaagcagtacaatcccgagtattcgggcatttcatcattttttaagacaggaagggactgattgtgaacaagtctgaattgatcgaagcgattgctcaagaagccgasatttccaaagccgccgcacaaaaagctttggatgccactaccaatgcagtaaccaccgccctgaaacaaggcgacaccgttactttggtcggtttcggtactttctacgtgggcgaacgtgcggaacgccaaggccgcaaccccaaaaccggcgagcctctgaccattgccgccgccaaaacgcctaaattccgcgccggcaaagctttgaaagacgcactgtaagccgttttttatgaaaaaagccgattctttaaagaatcggcttttttatcggtccacattattctgatttcaaatcggcaacacactgcttgtcacgtgcttcaaaggcatttgcgccgccgagcaggtcaagctgttcttgtgcgccgagtttgccgaaggatctaatctgtttctcgctcaatctgtccaaaggctgctcccacatacatttgcagtagtcgacggcgaggcgggtattgtttgaatctaaaccgcgggcccgcaaatcgttttgccatttttcggcaaacggaatattcttcacgcaagactcgacaattttctgttttgcctgcggtttggacatcgcgcattgggagagcagggcggttaaagcgagcaacgccaaaatgacccacgcccaaatgcggatggtgcggattttggcttttgcttttttgcgcgcggcaacctgctctttcgtcagcatttcgtgtttcggctcagtcatgcaggctttccatgcggatcatggtaatcggtttttccacgcaatccagtgcttcgatggctgcgattgccgacttgatgtgtttttcgaccgtgctgtgggtcagaatcacgatttcggcagtggtctgatcaatcacgcctttttgaatcagtgcttcgatggacacgttttcttgtgccaacagcgcggcgatttgccccagcgtgcccggttcgtctttggcttggacgcgcaggtagtagctgctggtaatttcgtccataggcaggatggtttgcgcttggacttgcgcgggttggaacgccagatgcggtacgcggtgggcggtatcggcttcaaccaggcgggcgatgtcgatgatatcggcaaccacggcggaagcggtcggcaatgcgcccgcgcccgcgccgtaatataaggtttcgccaaccatatcggcgttgacgcgcacggcgttcatcacgccgttgacgtttgccaagaggcggctttcgggaatcagggtagggtggacgcgcagctcgatgcctttgccggttttgcgggtaatgcccaacagtttgatgcgatagccaagttcttcggcgtatttgatgtcgcggctgtcgagtttgctgatgccttcgaggtagcaggcggaaaagttcatcggcgtgccgaatgccagtgcgctcatgatggtgattttatggcccgcatcgttgccttcgatgtcgaaggtcggatcggcttcggcataacccaatgcctgcgcttctttcagtacatcggcaaacgcgctgcctttttcgcgcatttcggagaggatgaagttgctggtgccgttaataatgccggcgatggatttaatcctgtttgccgccaaaccttcgcgcagggctttgatgattgggataccgcccgctactgccgcttcaaattggacgatgacgttttgtttttccgccagcgggaagatttcgttgccgtattcggcgagcagttttttgttggcggtaacgatgtgtttgccgttttcaatggctttcaacaccgcatctttggcaatgccggtaccgccgaacaattcgacgacgacatcgacgtcttcacgtgcgaccagttcgaacggatctttgacaaaggctgcggacgggcaggtttgtcgggctttttcttcactcaaatcgcacacggcagaaatacggatttcgcgccccaagcgacgggaaatttcctccgcgttgtcccgcaacacggcagccgtaccgccgccgaccgtacccaaacctaaaagaccgatgtttactggcttcattgtgtctccttgtaagccgactgaaatgtaaatattgaaagacgaaaatatccgctgccgatataattgtgccgcactttgaatcaaatgccgtctgaaatcggcaggcgggtcagatgaaatctgccaatcctacatgaatttgtctgattttgcatccctttcggtgtagatgatgcggcaacggggtaaaaaaatgttgtttgaagaaaatccgatagacggacagtttgcggaatatgaatgcggtgcgggcggaatccggctggcggggcaaagtttccataaacccgtgcttgtacataaggattcggtctgcctgtcgcaatgccgaaccttgtccgatctgactccggaaaacctgttgtccgacgtcaaacctgttgactatccggaaatattgattatcgggacgggcgcggctcaggagtttatccatcccaaaatcatggcggatttttcccgaatcggaatcagcgtggaatgcatgaataccgattcggcattcaggacattggttttcctgcactcggaagggcgcagggcttgggcttggcttcagccgtaaatttcccgtttcagacggcatcggcactgactttcaggtaaaatacgggcttttcccgcccgacgatgtttccgttatgattgaaatcaaaaacctcaccctgcaacgcggtttgaaagtcctgctcgacaaagccaacgctaccgtcaatcccggtcagcgcgtcggtttgatcggcaaaaacggaacgggcaaatcgagcctgtttgccttaatcaagggtgaaatcactcaggacggcggcgatgtctcgattccgaaaaactggcggctcgcttccgtttcccaagaaacgcccgatttggatatttccgctttggattacgttttgcagggcgatgccgagttgcaggcttttcagacggcattgaggcaggcagaagcgcaaaatgacggcatgaagcaggcggaatatcatgctaaattggaagaaatcgacgcttataccgcgccggcgcgtgcggcaaaattgttgaacgggctgggtttttcgcaagaagaacacagccgccccgtcaaatccttttccggcggctggcgtatgcgcctgaatcttgcgcaagccctgatttgccgcgccgatttgctcttgcttgacgaaccgaccaaccacttggatttggaaaccgtcttgtggctggaaaaccaccttgcttctttaccctgcacgcaaatcatcatttcccatgaccgcgattttctcaacgcggaaactacccaaaccattgaattatcgcagcaaaaactcacgcaatacggcggcaattacgatttttaccaaaacgaacgtgcgcagcgtctcgcgcaacaacaagctgcctatgtcaaacagcaggcgcaaatcaaacatttgcaatcctttatcgaccgcttcaaagccaaagccaccaaagccgttcaagcgcaaagccgcatgaaggctttggcgaagctcgaacgcatcgctcccgcgcatctggacagcgagttttcctttgagttttaccatcccgaccatctgcccaatcctttgttaaagctagaacacgcagatttgggttacgaaggcaaaactgttttgcacgacattaccctgtcgctggaaagcggcgcgcgctatggtttattgggtgtcaacggcagcggtaaatctacctttatcaaagctttggcaggcacaatcgatttactctccggcagcatcgtccgttccgaaaaactcaatatcggctattttgcccaacaccaactcgataccatccgctccgaccaaaaccctgtttggcatattcagcagctttctcccgaagtacgcgaacaagaaatccgaaatttcctcggaggcttcaattttgtcggcgatatggcgttgcagaaaaccgaaccattttccggcggagaaaaagcccgactcgctcttgccatgattatctggcaaaagccgaacctgctgctgcttgacgagccgaccaaccatttggatttggatatgcgccacgccttgacgctcgctctgcaaagtttccaaggcgccttaatcgtcgtatcgcacgatcgcagcctgcttgaagccacgaccgacagcttcctcctgatcgataaaggccgtctgaagaacttcgacggcgatttgaacgactaccgccaatggcgtttggcacaggaaaacgccgccgtcgcgcccgcagcatccgcacaaagccaaagccgcaaagacaccaagcgcatcgaagcgcaaatccgtcaggaaaaagcccgacgcggcaagccgatacagcagaaaatagaccgtgccgaaaaagaaatggcgcagctttccgaaattcagacggcatgtgaagcatttttagcacaagaagaagcttacttcgaggaaaacaaagaaaaattgcaggacaccttatccgagctggcaaaagtcaaaacacaacttgcccaaatcgaagaggtttggctggcttgccaagaagaattggaacagattgaaactgaaatcgagaaacagtttgccgagcgataaagaagcgcgggcagggtgcttatctttgcctgccaataacggtataattcgggcgttatcaccgccttttaccggtataaacatcagactttttgccgccttgggtctcctgtccctttccggcgcggcggcgcaagcctccgtataccattgcaactcaaatggcaaaagcgtatatacatcagccccagcaggattgtgcgccgatgcggatttacctaaaatcagcagccatcagggaggcggataccgcctgaaaattaaaaaactcagttaagaagccaaaatacacatagaaagtaaaaagaaaaacaaaaaacctgccgggaaaaagaacaagcaggctgccaaagccccgaaagaaaatcaaaagcaaccaaccgaaaagaaaagcccgtaaaacgccaagaaagcattacaaaaaataccaaaaaatcaaatgattatccgaaaatcaagcacattatgaaatcaaaactcctcttaatcctaatcaacttttccctgatttcaagcccattgggtgcgaatgcggccaaaatctacacctgcacaatcaacggagaaaccgtttacaccaccaagccgtccaaaagctgccactcaaccgatttgcccccaatcggcaactacagcagcgaacgctatatcccgccccaaacgcccgaaccggtatcatcaccgtcaaacggcggacaggttgtcaaatataaagccccggtcaaaacagtatccaagccggcaaaatccaatacgccgccgccgcaacaagcaccctcaaacaacagcagacgctccattctcgaaacagaattgagcaacgaacgcaaagcattggttgaagcccaaaaaatgttatcacaagcacgtctggcaaagggcggcaacatcaaccatcaagaaataaatgcattacaaagcaatgtattggacaggcagcaaaatattcaagccctgcaaagggaactggggcgtatgtaaagccgtgttttcaaatcgaccgttccaaggatttgacagaagaaatgatgaaaaagcagcggcatatcctgtgtgtcggctgcctgtatattatattgaaggtcaacgtatttcccaataccggctggatggaagcgtcgaaagggatgcagggcatgtcgttcagtaccttcggatacgcggatgctccgggctatacattcagccgcattggccatactttaattttcctacttggaaagaccacagggacacgtacaactgtttccgatagttcgcataatgtatattatgttaaattatatatttgtgcaaataactccaaggcattaagctgttgtttgatgctttgccagtttgggagaaagttgtccatatgcgccataaaacgggcgttgcgatggcgttcgagcaaatgggtcagttcgtggacgacgacgtattaagcggtgcggacacccgaaccgcgatcccctaaatgtcttggtgggaatttaggggattttggggaattttgcaaaggtctcaaaacccgctcgccttatagcctgtctgtgctgccatttcagcctccaaaacccatattttcaaggtgggcattgactttgctttgccacttttccacttctcgggcaagctcggccatcgggctgcggtagcggtcttccagcgtgttcaagcggctgataagctgctgaatactgttttccaagcgattttcgattcggctttgtaaatcggcaagccatttgtcttgaacggcaagctgcttgatttcggcttcggaaagtcggccaaattgtttgaatacggcaaggttcagggcttcgatttgggttttgactgcgtctttcgcggctttttcctgcgtcatcagtgtttgggtggtttgtaaaacagcccgttcgccttcttctatgccgctttcttccaatgcggttttcagaagtttggcggaaagtttgccttttgcatccaatacgtcgttcagcgcaccctcttcgccgccgtgttcttctatgtggttttccaattcttggcttaggcgttccagctcgctttgtttttcttccagcttggcgatgccgtctgaaaagtagcggcgggcaaccagctcgggggcgatgacttcgctgcggtattttttgctgatgcgcttggttttggctttgccttttttgtcggtttcggtttcctcaaagacgacggtcaggttcgcggcttcatcgctttctttggtgatttcggccaggtttttaaccgccttccagccatcttgggcgatgagataaacatcgtcttgcagggtttccgcccagtagtccgtcaggatttggtagaaatcgtattcttcaatcaggctgccgggtttgaacgcgtccagcaggctttcgctccatttccggataagcctgcccggttggatggcggcaaggtcgttttgagtgtgccacgcggcaaactttgctaggtgtccggctttgaaggcggcgtaatcggggtgcgccaatatatgggctttgatttggctgctttcgattttatagtggattaaatttggggctgtactagattagccctaaattccacaccaatcccgcaggattttaagctgttgagagtgggaaagatttgcaatcgattccgttgtatagtggtaaagtggccatcgtgttcggcaaacaactcgtttttcatacggcctaaaacttgccaataggcttccaatgcgtccatatcgtgcgcaggtatgccgccataaagatagataggcggcgagattttgcaggtcttcgacttctccgctgtcgatatagcgaggcagattaaggttgtaatcttgtgctgcgatttcgcttaaatgcaccatacggctgtaacgaggtttgtgaaagtgtcgatgattttgtgaatgtcttgctcacgcagacggtttttgttgccgtctttaatgaagccgcgcgatgcgtcaatcataaacacgctgccgccgctgataacttggtttgttccctcttcggcaaattgggcggtttgggcgtgttctttgtcgatgacgatgatgcaggcaggaatgcccgtgccgtaaaacaggttggcaggcagcccgataatgcctttaataaggtcaaggttaagcaattccgtgcgaatacgcgcttcggcattgccgcgaaacagcacaccgtgcggaagaataatcgcacctttgccgcttggtttcaggcttttgagcagatgcagcaaaaaggcgtaatcgccgtttttttcgggcgggataaggcggattggcaacggcaaaatcgaaggtcttaagcccgtcgttttcatcacggaaagacgaatcggacaagtgttcccgtgttgatttcggcggtttcgttgttgtgcaaaatcatattcatacgg

SEQ ID NO: 37825 - DNA, 532 bp, Neisseria meningitidis
  misc_feature (1)..(532): N is any nucleotide
ctgagcgcggaaatggctttcagacgncatttgcgctcaataataatatcccgcgntcagaatacacggtttggatgcgccggttgctttgtgcggactaccgggaatgcgattaatccaacacgccgccaaccacgcaaatncggcggcttccacccattgcggatcgaggttcaggtcggcggtgctgtgcagggaaacgcgtgtgccgaaacattctgccaaatccgccattaaaacaggattgcggatgccgccgtcgcaaatgtacatttgacgggcatctgccgctgcgtgtgagacggcgtcgcaaacggtttgcgcggtaaaacgggaaagcgtccgcaatacgtcgtatcggttttcgccgccgtcaaggtaggtttcgagccaatttatggcaaacagttcgcgccccgtgcttttagggtggcgttgtgcgaaatacgggtgggcgagcagcctgtcgagcagttgcggcaatatgttgccttgtgccgactttgcaccgtttttgtcgtaaggaagctgc

SEQ ID NO: 37826 - DNA, 33303 bp, Neisseria meningitidis
cccgtatcggatgatttttgggggaatggttgcgctcatgttttttgataacgggaaacccgtttttctctgtagaaaggtaagcgtttactttaagtaattgactgttgcgggtcaagtctaattttaaaaaataatccggtttttcttacaaactgcccccataacgcttactgtaccttaatctgatggttttcgataataattatcattacaatgcaatgccggttcgtttgcttgtgaacattcaagatgccgactctgacggcattcagacagcatctgaaaacaataacggcacaaggatggggtacaatcgccctatggaaaaaaacaccctatccgcccgcgcaccatccccttggctgccgcttctgctggcaattgccatttttatgcagatgttggatgcgaccattttaaataccgcactgcctgaaattgccgccgacctgaatgagtcgcctctggatatgcaactggcagttatttcctacacgctgacggttgccctgctgattcctttgagcggttatttggcggacaggttcggaacgaaaaaagtctttttcggttcgattgccgtttttatgctcggatcggcattgtgcgccgcatcgggttcgctgtttgaattgacgctttcccgtgtcgttcagggcatcggcggttcgatgctggttccgataccgcgtctgaccatcttgcgtgtgtacgacaagtccaagctgctcaatgccatcaattatgcggttatgcccgcattaatcgggccggttttagggcctttggcgggcggttatttggtcgaatacgcttcgtggcactggattttcctgctcaacctgcccatcggtctgctgggtttcatattgggacgcaacatcatgcccgatattaaaggcagtaatatctctttagacttcaaaggttatctgattttttctgccgccgcgtgcctcttgttactttcggcagaaagcctgtcgcacgcgctgcctccgtattttgcactgttgccgctgtgcggcggactgctgtttgcacgccgttatttccgacatatgaaaaccgcgtccaaaccgatttattccgccgacctgtttctgatacgcactttccgtctgggactggcgggcaatctgttcagccgtctcggcatcagctcgattccttttctgatgcccctgatgtttcaaatcgctttcggcttcggcgcaagcctgtcgggttggctggtcgcacccgtcgccctgtcttcgctgctggtcaaaccgctgattgcaccgctcatgaaacgtttcggctaccgcacggtactgctttggaacaccaagctgcttgccgccttcatcatgctgctcgccctgcctgacggaaactcgccgctgtggatttgggttttcctctcgctggcgatcggcgcgtgcaactccctacagttttctgccatgaacacactgaccctcgccgatttgcgcccgcaacaaacaggcagcggcaacagcctgatggcggtcaaccaacagcttgccatcagcatgggcattgttgccggcgcattaatccttaaaaactggacatttctgataccggcttcttcaggtctgcattccgccttccgtatgaccctgctcagcatcggcggcatcacccttgcatcatcgctggttttcaaacggctgcacgtttcagacggcaccaacctgacacggaacacaccgtcctgaagcggtccacacgcaaaacttttacccgtttcaacgtttggattatgataccgcacttccatgcgcgccaaccccaaaacacaggcaatgccgtctgaaaccatatccctgatgaaaacacgcagcctaatttcccttttatgcctccttctctgttcatgttcttcatggttgcccccactggaagaacggacggaaagccgtcatttcaatacttccaaacccgtccgcctggacaacatcctgcaaatccggcacacccctcataccaacgggctatccgatatctatctgttgaacgacccccacgaagcctttgccgcccgcgccgcccttatcgaatctgccgaacacagcctcgatttgcaatactacatctggcgcaacgacatttccggcaggctgctgttcaacctcgtgtaccttgccgcagaacgcggtgtgcgcgtacgcctgctgttggacgacaacaacacgcgcggattggacgacctcctgcttgccctcgacagccatcccaatatcgaagtgcgcctgttcaaccccttcgtcttacgaaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgatttggacatcctcgccaccggcagcgtcgtcggcgaagtatcgcacgacttcgaccgctactgggcaagccattccgcccacaacgccacgcgcatcatccgcagcggcgacatcggcaagggtcttcaagcactcggatacaacgacgaaacgtccagacacgcgctcctgcgctaccgcgaaaccgtcgaacagtcgcccctctaccaaaaaatacagacaggatgcatcgactggcagagcgtccgaacccgcctcatcagcgacgaccctgcaaaaggactcgaccgcgaccgccgcaaaccgccgattgccgggcggctgcaagacgcgctcaaacagcccgaaaaaagcgtctatctggtttcaccctatttcgttcccacaaaatccggcacagacgcactggcaaaactggtgcaggacggcatagacgttaccgttctgaccaactcgctgcaggcgaccgacgttgccgccgtccattccggctatgtcaaataccgaaaaccgctgctcaaagccggcatcaaactctacgagctgcaacccaaccatgccgtccccgccacaaaagacaaaggcctgaccggcagctccgtaaccagcctgcacgccaaaaccttcattgtggacggcaaacgcatcttcatcggttcgttcaacctcgacccccgttccgcgcgtctcaacaccgaaatgggcgttgttatcgaaagccccaaaatcgcagaacagatggagcgcacccttgccgataccacacccgcctacgcctaccgcgttaccctcgacaggcacaaccgcctgcaatggcacgatcccgccacccgaaaaacctacccgaacgaacccgaagccaaactttggaaacgcatcgccgcaaaaatcctatccctgctgcccatagaaggtttattatagaaatatagcggattaacaaaaaccagtacgacgttgcctcgccttagctcaaagagaacgattctctaaggtgctgaagcaccaagtgaatcggtttcgtactgtttgtactgtctgcggcttcgtcgccttgtcctgatttttgttaatccactataccgtctgaaacaccttcagacggatatccgaacccgcaaaggaaaaaccatgtttccccccgacaaaacccttttcctctgtctcagcgcactgctcctcgcctcatgcggcacgacctccggcaaacaccgccaaccgaaacccaaacagacagtccggcaaatccaagccgtccgcatcagccacatcgaccgcacacaaggctcgcaggaactcatgctccacagcctcggactcatcggcacgccctacaaatggggcggcagcagcaccgcaaccggcttcgattgcagcggcatgattcaattcgtttacaaaaacgccctcaacgtcaagctgccgcgcaccgcccgcgacatggcggcggcaagccgcaaaatccccgacagccgcctcaaggccggcgacctcgtattcttcaacaccggcggcgcacaccgctactcacacgtcggactctacatcggcaacggcgaattcatccatgcccccagcagcggcaaaaccatcaaaaccgaaaaactctccacaccgttttacgccaaaaactacctcggcgcacatactttttttacagaatgagccgcccgccgcgccgcgccggaatcgcggcaaaatgccgccttattccgctgtttcggtcagcgatgagaacacgtcgaaataagtcgggaaggttttgtgggtgcatttcggatcgttgatgacgacgggtacgcccaacagcgaaaccagcgagaaacacatcgccatgcggtggtcgtcgtacgtgtcgatgacggcgtcgggtgtcagcgtttcgggcggggtgatgtgaattgcttcggcttcttcgacgacttttgccccgagtttgcgcaactcgtttgccattgcggcgatgcggtcggtttctttgacgcgccacgaaccgatgttgcgcagcgtgcaggtttgccctgtagcaagcgcgacgatggcgagggtcatggcggcatcggggatatggttcgcatccaaatcaaaggattggacggcacgttccttcgggcgtgaaacttcgacgaagttttcgccccaaaccacgtccgccccgattttttccagctcgcgggcaaaggcgacatcgccctgtatgctgtttgcgccgataccggtaacgcggacgggcgtggcggcaatcaaaccggctgcgaggaagtaggacgcgctggaggcatcgccttcgacgtgcaagtgttcgggcgcgtggtagtgcgcatcggcgggaattttgaagacgcggtagccttcattgataacctgtacgccgaattgcgccatcagttttaaagtaatgtcgatatagggcttggaaatcaattcgccgaccatacggatttcaaacgcctgcccggtcagcggcaacgccattaaaagggcggtcagaaactggctggacacattgcctttaatcggaatcacgcgctcgccgttgtcttggcgttcgccgatatgaagcggcggatagtgttccttgccgagatattcgacatcggccccggcaatccgcaacgcatcgaccaaatcgccgataggacgttcgtgcatacgaggcacgccgtgcagatgataatcgccgcccaaaacggccagagcggcggttaacgggcggaacgccgtgcccgcgttgcccaaaaacaaatcggcagtgcggttggggaagcgtccgcctgtgccgtgcactttcagacggtcttcggcaagatattcgatttgaacgccgagtttatcgagtgcttcgagcatacggtcggtatcgtcggatttgagcagggaatggatttcgcaagcattgtcggacaaggcggcaagcagcagggtgcggttgctgatgcttttggagccgggcagggcgacggtggaaggtttgagacgggcgacggggaggcggacggattcggtcatggcaaaacgtcaatattattaaagataaaaacagcctgcattatactggtgcaaatgctgtatgaaaaatctcaggcttggcattttcggttttaaagtccgtaaatgtggttttttatgccgaaaattgattatttttaaattttttgtttctaaaatttctttgtcggcatattttcagcttttgttgcggacatggcgcgtttgccggcggcgcggcacgattgccaatttcatagaatttggtagaatagccgctgttcaacgacagacaagccgccgattttccgggcggcttgtatttttattttaatatccggacgcacaaaacaagacggtacgcggtatgcttgctgccgcaaaccggtgtgccggaatatggagaaaaaagaccgatgcaaaaaatccccctgaccgtacgcggtgcggaattgctgaaacaggaattgcagcagctcaaaagcgtggcgcgtcccgaagtgatcgaagcgattgccgaagcccgttcgcacggcgatttgtccgaaaacgccgaatacgaagccgccaaagaacgccaaggctttatcgagggccgcatttccgagctggaacacaaactttccgttgcccacatcatcaatccgaccgaaatccacgccgaaggcaaaatcgtgttcggtacgacggttacgctggaagatttggaaacggaagaacacgttatctatcaaattgtcggcgaagacgaagccgacatcaaacagggcaaaatctatgtcggctcacccatcgcccgcgccttaatcggcaaggaagagggggatacggcggaagtccaagccccgggcggcgtgcgcgaatacgacattatcgaagtccgatatatttgattcggcttgatttcgatacacccgacacacgcaggaaattatagtggattaataaaaatcaggacaaggcgacgaagccgaagacagtacagatagtacgaaaccgattcacttggtgcttcagcaccttagagaatcgttctctttgagctaaggcgagacaaccccgtactggtttttgttcatccgctataacagcaaccctgtcgccgtcattcccgcaaaagcgggaatctaggacgcagggttaagaaaacctgcatcccgtcattccctcaaaaacagaaaaccaaaatcagaaacctaaaattcgtcattcccgcgcaggcgggaatccagtccgttcaatttcggtcatttccgataaattcctgctgcttttcatttctagattcccactttcgtgggaatgacggcggaagggttttggttttttccgataaattcttgaggcattgaaattccagattcccgtctgcgcgggaatgacgattcataagtttcccgaaattccaacataaccgaaacctgacagtaaccgtagcaactgaaccgtcattcccaccacttttcgtcattcccgcgaaagcgggaatccagaatctcggactttcagataatctttgaatattgctgttgttctaaggtctggattcccgcctgcgcgggaatgacgaatccatccgcacggaaacctgcaccacgtcattcccacgaacccacatcccgtcattcccgcaaaagcgggaatctaggacgcagggttaagaaaacctacatcccgtcattccctcaaaaacagaaaaccaaaatcagaaacctaaaatcccgtcattcccgcaaaagcgggaatccagtccgttcagtttcggtcatttccgataaattcctgttgcttttcatttctagattcccactttcgtgggaatgacggcggaagggttttggttttttccgataaattcttgaggcattgaaattccagattcccgcctgcgcgggaatgacgattcataagtttcccgaaattccaacataaccgaaacctgacagtaaccgtagcaactgaaccgtcattcccaccacttttcgtcattcccgcgaaagcgggaatctagaatctcggactttcagataatctttgaatattgctgttgttctaaggtctagattcccgcctgcgcgggaatgacgaatccatccgcacggaaacctgcaccacgtcattcccacgaacccacatcccgtcattaccacgaaagtgggaatctaggacgcagggttaagaaaacctacatcccgtcattcctcaaaaacagaaaaccaaaatcagaaacctaaaatcccgtcattcccgcgcaggcgggaatccagtccgttcagtttcggtcgtttccgataaattcctgctgcttttcatttctagattcccactttcgtgggaatgacggcggaagggttttggttttttccgataaattcttgaggcattgaaattctagattcccgcctgcgcgggaatgacgaatccatccgtacggaaacctgcaccacgtcattcctaagaacctacatcccgtcattccctcaaaaacagaaaaccaaaatcagaaacctaaaatcccgtcattcccgcgcaggcgggaatccagtccgttcagtttcggtcatttccgataaattcctgctgcttttcatttctagattcccactttcgtgggaatgacggcggaagggttttggttttttccgataaattcttgaggcattgaaattctagattcccgcctgcgcgggaatgacggctgtagatgcccgatggtctttatagcggattaacaaaaatcaggacaaggcgacgaagccgcagacagtacagatagtacggaaccgattcacttggtgcttcagcaccttagagaatcgttctctttgagctaaggcgaggcaacgccgtacttgtttttgttaatccactataaagtgccgcgtgtgtttttttatggcgttttaaaaagccgagactgcatccgggcagcagcgcatcggctcgcacgaggtctgcgcttgaattgtgttgtagaaacacaacgtttttgaaaaaataagctattgttttatatcaaaatataatcatttttaaaataaaggttgcggcatttatcagatatttgttctgaaaaatggttttttgcgggggggggggtataattgaagacgtatcgggtgtttgcccgatgtttttaggtttttatcaaatttacaaaaggaagccgatatgcgaaaaaaacttaccgccctcgtattgtccgcactgccgcttgcggccgttgccgatgtcagcctatacggcgaaatcaaagccggcgtggaaggcaggaactaccagctgcaattgactgaagcacaagccgctaacggtggagcgagcggtcaggtaaaagttactaaagttactaaggccaaaagccgcatcaggacgaaaatcagtgatttcggctcgtttatcggctttaaggggagtgaggatttgggcgacgggctgaaggctgtttggcagcttgagcaagacgtatccgttgccggcggcggcgcgacccagtggggcaacagggaatcctttatcggcttggcaggcgaattcggtacgctgcgcgccggtcgcgttgcgaatcagtttgacgatgccagccaagccattgatccttgggacagcaataatgatgtggcttcgcaattgggtattttcaaacgccacgacgacatgccggtttccgtacgctacgattcccccgaattttccggtttcagcggcagcgttcaattcgttccgatccaaaacagcaagtccgcctatacgccggcttattatactaagaatacaaacaataatcttactctcgttccggctgttgtcggcaagcccggatcggatgtgtattatgccggtctgaattacaaaaatggcggttttgccgggaactatgcctttaaatatgcgagacacgccaatgtcggacgtaatgcttttgagttgttcttgatcggcagcgggagtgatcaagccaaaggtaccgatcccttgaaaaaccatcaggtacaccgtctgacgggcggctatgaggaaggcggcttgaatctcgccttggcggctcagttggatttgtctgaaaatggcgacaaaaccaaaaacagtacgaccgaaattgccgccactgcttcctaccgcttcggtaatgcagttccacgcatcagctatgcccatggtttcgactttatcgaacgcggtaaaaaaggcgaaaataccagctacgatcaaatcatcgccggcgttgattatgatttttccaaacgcacttccgccatcgtgtctggcgcttggctgaaacgcaataccggcatcggcaactacactcaaattaatgccgcctccgtcggtttgcgccacaaattctaaatatcggggcggtgaagcggatagctttgtttttgacggctcgccttcattctttgattgcaatctgactgccaatctgcttcagccccaaacaaaaatccggatacggaagaaaaacggcaataaagacagcaaataccgtctgaaagattttcagacggtatttcgcatttttggcttggtttgcacatatagtgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcgaattgtcattcccacgcaggcgggaatctagtctgttcggtttcagttatttccgataaattcctgctgctttttatttctagattcccactttcgtgggaatgacgaaaagtggcgggaatgacggttcgggcattccttaaatcacccgtgtatcgctgtaaatcttagagatggcggaatatagcggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatatttgcttgcggcaagatgaaaacggtgcgggatgttttgggaaaccaatgccgtctgaagggctttcagacggcattttttgcgccgtgctgtttaacgcgccagcggttcggtgcgtttgatcagccacgcttttgccgcgccttcggtcagcggctcgaggcggcggcggacttcggcgtggtagcggttgacccagtcgatttcgccgtcggtcatgagggcggtgtccatcaggcgggtgtcgatggggcagagggtcagggtttcaaaacagaggaagctgccgaattcggtttcttgaggggcggcgacggcttggttggcggcaaggttttcaatgcggatgccccattttcccgggcggtagagtccgggttcgatggaggtaaccatgccttttttcatggcggtttcgggcgtggcgggggcggcgaaggcgatgcgctgcgggccttcgtggacgttgaggaaatagcctacgccgtgtccggtgccgtggccgtagtcgcattgcgcctgccacaggggtttgcggcaaatcgcatcaatcagcggcsasgggatgttttcggggaacacggcttcggcaagcgcgatatgggctttgagaacgagggtgttgtcgcttttttgttcggcactcggcgtgccgacggggacgacgcgggtgatgtcggtcgtgccgcctttgtattgcgcgccggagtcgatgagcaaaagcccgttgccgctgatggtgctgtggctttcgggtgtcgcgctgtaatgcggcagtgcgccgttggcgttgaagcctgcgatggtgtcgaaactcaatgaaatgaagcctgggcgcacgctgcggtggcgataaagcatggtgtccacgtcgatttcggtcaggctgccgccgttgccgatgatgtcttcaaactcggcgaagaaaccgcacaacgccgcgccgtcgtgttccatcgcttcgcggatgcgggcgatgtcggcttcggatttgcaggatttgaacagcgtggatgggttgattccctcgataaggcgcacgctttcgggcaggcgcacaagcgtgctgacggcggttttgttcggctcgatgagcagcacgccgccgatttgcgcgagtttgtcggcaacttgggcgtaaggttcgaccgcgatgccggcggtttgcagcgcggcggcggcttcggcgttcagacggcatcggtcggtaaacaggacggcgttgtctttgccaatcagcaggaaggacacgaaaacgggattgaaaggcacgtcgctgccgcgcaggttggtcagccaggcgatgtcgtcaagcgaggaaaccaagtggtaatccgcgcctttttccgccatcacggcgcgcacgcgggcgagtttttcggcggcggtttcagaaacatagtcggggtcgtggatgaacaccgtttcggcggggagggcggggcggtttgtccacacttgattcagtaaattatccgggtgttcgatgcggatgtttttggcggcgagtgattgcgccaaagtgcgtttgccggtgagcgagaccatatcggaagggatgccgacggcggcgttttcgggcaggcttgccgcgagccattcgttgtacggcggcacttgcccgcttttttgcagcacaatgccgctgcccgcaagctgtttggcggcttgttcccaatagcggctgtccacccacacgcccgcttcatcggtggtcaggacaaacgtgccgaccgagccggtaaagcccgataattcgcggcgcgcctgccaatgctcgggcaggtattcggacaggtgggggtcggcggaagggatgacgagtgcatccaagccttgcgccttcatggcttcgcgtaatgcggacagataattcgatacggtattcataacagttcctccaatcgggttttgcggcttcagatggcatggacggaaatctgaaatgccgtctgaaaaacataaccatcttatcaaatcgccagcctgctgcaaaacggacgggctgatcggatggtgcgtgtttgcgcgaaaaaagcgatgtaaggttgtttgttgtaaaattttaggcataaaatgtcgttttatgcctttttttggaagtaatatggaaaatatagtcaagtttgagcatgaagttctaatagtgtgtgttggcaggtatttggattacgttacaatacgtgttttcatcaaaatttccctaccgggcggtatcctgtttttgaagacggtaggatttgggtttgtttgggggcaatcccgcccaaattggagcaatagatagggctgtgtccgaatatgcggctctgtgtgttgaaacacagttaaaaatacggaagactttatgtccgaacaacatatttcgacttggaaaagtaaaatcaacgcattgggtccggggatcatgatggcttcggcggcggtcggcggttcgcacctgattgcctcgacgcaggcgggcgcgctttacggctggcagatcgcgctcatcatcatcctgaccaacctcttcaaatacccgtttttccgcttcagcgcgcattacacgctggacacgggcaagagcctgattgaaggttatgccgagaaaagccgcgtttatttgtgggtattcctgattttgtgcatcctctccgccacgattaacgcgggcgcggtcgccattgtaaccgccgccatcgtcaaaatggcgattccctcgctgatgtttgatgccggcacggttgccgccttgattatggcatcctgcctgattattttggtgagcggacgttaccgcgctttggatcgcgtttccaaaatcatcatcgttactttgagtatcgccacgcttgccgccgccggcatcgctatgtcgcgcggtatgcagatgcagtccgattttatcgagccgacaccgtggacgcttgccggtttgggcttcctgatcgcgctgatgggctggatgcccgcgccgattgaaatttccgccatcaattctttgtgggtaaccgaaaaacaacgcatcaatccttccgaataccgcgacgggatttttgatttcaacgtcggttatatcgccagtgcggttttggctttggttttccttgcactgggcgcgtttgtgcaatacggcaacggcgaagcagtgcagatggcgggcggcaaatatatcgggcaattgatcaatatgtacgccgttaccatcggcggctggtcgcgcccgctggtggcgtttatcgcgtttgcctgtatgtacggcacgacgattaccgtcgtggacggctatgcccgtgccattgccgaacccgtgcgcctgctgcgcggaaaagacaaaacgggcaacgccgaattctttgcctggaatatttgggtggcgggcagcggtttggcggtgattttctggtttgacggcgtaatggcgaatctgctcaaatttgcgatgattgccgcttttgtgtccgcccctgtgtttgcctggctgaattaccgtttggttaaaggtgatgaaaaacacaaactcacatcaggtatgaatgcccttgcattggcaggcttgatttatctgaccggttttaccgttttgttcttattgaatttggcgggaatgttcaaatgataacgatgccgtctgaaaccgcaaaccgctttcagacggcattgtcgcgtttatggaaaaaaatgccgacatcgcgtaaaatatgcgcaaattttgtgattcggtcaggtcgtctgaaacagattgcgcctgatttattttttcggaaaaccttatgagcgaacaaaaccatccgcaaaccgagccgcagttggacgaaaaccaaatcatcgccctgcgccgcgaaaaactgcacaacatccgccaacagcgcaacgcctatcccaacgacttcaaacgcgacagcttcgccgccgatttgcacgcccaatacggcgaaatcggcaaagaagaactcgatccgcaaggcattcccgtcaaagtggccggccgcatgatgctgaagcgtcaaatgggcaaggcgagttttgccaccattcaagacgtgtccgggcaaatccagctttatctgaacaacaaaggcgtgagccaagaagttttggacgacttcaaccattgggatttgggcgacatcgtcggcgcggaaggcactttgttcaaaaccaaccacggcgaactgaccgtacgcgtgtccggcatccgcctgctgtccaaatccctacgcccgctgcccgacaaacacaaaggtttgagcgatcaggaaaccaaataccgccaacgctatgttgatttgattgccaatgaagaatcgcgcaatacctttatcaaacgcagccaaatcatccaatccgtgcgtaattttatggtgggcgagcattatctcgaagtcgaaaccccgatgatgcacccgattcccggcggcgcgacggcaaaacccttcgttacccatcacaatgccttagatattccgctttacctgcgtatcgcgcctgagctgtatttgaaacgcctggttgtcggtggtttggaacgcgtgtttgaaatcaaccgcagcttccgcaacgaaggcatgtccgtgcgccacaaccccgaattcaccatgatcgaattctacgaagccttctccgactacgaacgcatgatgcagatggcggaagacatcatccgcaacgcatcgcgcacggtaaacggcacggcaaacatcacttacaacggcaaagaagtcgatttggaaagcccgtttgaacgcctgaccattctcgaagccatcaaaaaatacaatccgcactacaccgacgagcagttgaacgatgcggaatggctgaaaaaagaaatcgtcaaacacggcgaaagcctgccgccgtccccgggcatcggcagcctgcaactcgcgctgtttgaaggttgcgccgagggcaagctgtggaatccgaccttcatcgtcgattacccggtcgaagtttcaccgttggcgcgcgcttcggataccaaacaaggtctgaccgaacgtttcgaattgttcgttgtcggccgcgaactggcaaacggctattccgagttgaacgaccccgaagaccaagccgaacgcttcaaagcgcaagtggtgcaaaaagacgcgggcgacgacgaagccatgcactacgatgccgactacatccgcgcgatggaattcggtttgccgccgaccggcggttgcggcatcggtatcgaccgcttggtaatgctgctgaccgattcgcaaaccatccgcgatgtgattctgtttccgcagatgcgccccgagtaatcataaaaacagttgaaatggcaatgccgtctgaacccgattggattcagacggcattttgtatggcggtacggatttattcggtttccaactgaccgacccattcggacaaggcagtcaggcgttgttcggatttcgccacgaacgggttttcggtatcccacgcgtagcctgccaaaatcgaagaaagcatacggctgatttccgggctgcggtcgggcgcgtacacgacgttttggaagcggaaatcataccaaccgtccacacatcaggggcggtaatccgaatcaacacgccttcttgcctgtgcggcggacataaaccgttttttgactccagcaccacacctaaaatcgtgctgccttcgggcaggtcaaaggcttcagacggcctgcccgtctgataaatcagcatcctgcccgcaatatcgataacaaggtgcgcgacgaccagccgcttgtcggacagttcaatcagcgcgatgtcttcgtccgcagggcacatacgcggctcgaccaccagcaagtctcccttttcgataaccggcgacatggacgtgtcgggcatggcaacggcaaacgtgtactgcgagggggcgaccaccgaagcaaacaggtcgaaactgcccgtgagtttgcctgtacgggcgaaagccgccgcctgacggtctgacaacaaaggacggggtgtgagcctcatcgacagtgctttgccatcggcatcgctgtggttgtgcgtatgcgtatgatggttgttgatggtcgtatcgccttggacatcgttaaggactatgctgtttgaacctgccacggatttggtcatctcattgtaggcttgcgtcgtgatgcgctcttgcttggtcatacctgttacagcctgtttcagcatttctaacgctatgtgattcttcctaagggtcgctataccggcttttgcagcttgctcattaccacaagaggggcaaccccagctacttcctatgaacatattggagtacctcgaacaggtttggtttccatgtttagggcagttgattacacacggcttggctgtaccctcaaactcgaccaacttaatgccacgatgaccgaaacgttcctcaacctcagcagcagcttcttcaaatgtttttgaccttcttgccatattgacctccggattattgattattttggctatgctttaacgagggattggaatgaggtaaagctgttgccctctccccgcaatagttccattaggcgcggatgaatgaatagtttgtccctgccgatgacgatttcttgcagcacacctatgtctgaaagctctttcaggtacttagaggccgtctgccgtttggctatccctgccgcttctaggttggcaatgcgtgtatatggctgctcaaacagaagatttaccagttcgtgcgtgtagattccttgtgcgtgtgtccgtatgtgttgccgtgtctgctcgaacaggcggcgtatcgcatctattttcgataccgtccaatcggcggtgtcagctacgccgtctaagatgtagattatccagctttcccagtcctgccgttcggttacgcctaaaagcaggcggtaatagtccgccctgttttcgatgatgtagcggctcaaatacaaaataggcaaatccaaaagccctttttcaatcaatagcaggctgttcaatatgcgccccgtccgcccgttgccgtccgtaaacggatggatggcttcaaattggtaatgtgccgccgccatgatgataagcgggtctaaatcgccgctttcgtgaataaaccgctcccaatttgccagcttgccgcgtatggtttcttctccttcgggcggggtatagacaacatttccgctgttgcctccttttagggctgtgccgcctgttttgcggatggccatttcgtaggggtgcttgatggcgttgcagaccatgatggcggtttgtgtgcataaagggcggctcgtcagtgattcatagcctgcaaacagggcggtgcggtattgcagggcttctttcgtggcagggtcttgccgttccgtatccatttgcagggattgaaacagcttgtccgtggtggttacgatgttttcaatttccgaacttgcacgggcttccataacaggaagggtgttaatcagcatggcttgattcggtatcaattctgccgcctgctttaaacgggcaagggatgcacgggcggctatacaacgtttcaggatggttttgctttcaatatcctgttttggcggcaggggtggtaaatcgttatagggaatattgggtttccagttgctcatatttaaaatttcggaaaatttaaagatgtttccagtatatgtttacgccgtgtatatatcaaggatatatgtttaaaaatttggcttttgtaaatatatgggcggtaaaaccgcattattttatgctgttacctattttacaccttgtctgcacacgatttccaaacaacctaaaaagaaacctgccgaaagacaggtttaaagaggtcattttaaatgtgaactaaagcttacaccctcgtagggtatcgtgtatatcagacgtacttaatatacactattaatggattaaatttaaaccagtacggcgttgcctcgccttagctcaaagagaacgattctctaaggtgctgaagcaccaagtgaatcggttccgtactatttgtactgtctgcggctcgccgccttgtcctaatttttgttaatccactatattgtacaggcggcaaatgccgtctgaaactgtttgcggcagaaatttatccggtgcgggcggttgctcccgatgcgtcagtccggtttgaaaaatgccgtctgaaacgggaaatgttcagacggcatttgattttcagggctattttacgccgtaacgcggttggagcagggcgcacgtccggtgttcccggcggcttcggcggctgcgtccggcaatttttccgcaagccgcgcccgcatcgtttgccgcattttccggccgggtgtttttttcgcgttgcgctttggcggattcgtagcggttgcgttgtctcggttcgcgcatttcgggtttttccggttttgcgccgccctgttcccaccattgcggctcgaagccctcgatgcgctcgatgagcagcttgttgccggtcagctctttaatggattcaaacattttctgttcggattcgtccatcagggaaatcgccacgccgtccgcgcccgcgcgccccgtgcgcccgatgcggtggacgtagtcttcgggctgggcgggcatttcgtaattgatgacgaagggcagttcggcaatgtccagcccgcgcgcggcgatgtcggtggcgacgaggacgcgcaggttgccgtctttgaaggcgttgagtgtttcgagccggctttgttgggaacggtcgccgtgtatcgcctgtgcggacaggttgcggcgcaccagttcgcgcgttacgcggtcgacgctttgtttggttttgcagaacacgatgacctggttcatatgcaaatcgacaatcagccgttcgagcaggttgcgcttctgaatggtatcgacggcgatgatgtgctgctcgacgttggcgttggtggtgttttgcgcggcgacttcgacggtttcgggcgcgttcatgaagtcttgcgccagtttgcgtatcggggcggagaaggtggcggaaaagagcagggtttggcgttggcggggcagcatctgcatgattttgcggatgtcgtcgataaaacccatatccagcatacggtcggcttcgtccaaaacgacgatttcgactttgttcaaatggatgtttttctgtttcacgtggtcgagcagccgtccgacggtggcgacgacgatttcgcagccggcacgcaggtcggcggtctgtttgtccatattcataccgccgaacaagacggtgtggcgcagcggcaggtttttgatgtagccctgcacgttttggtcgatttggtcggcaagttcgcgcgtgggggtgaggacgagcatacgcacggggtgcatcgcgggcgaggtgctggcggtggcgtaacgtttgaggcgttccagactgggcagcataaaggcggcggttttgcctgtgccggtttgcgcggcggctagcaaatcatgaccggcgagtgctttgggaatggcggcggcttggatgggcgtcgggttttcgtaaccttgcgcggtcagtgcggaaacgagttccgtacccaaacctaaagaggaaaatggattactcataattgtagtctttctttcagaccttatgtcgtctgaaacgggaaaccgataggacggggaaatatagtggattaacaaaaatcaggacaaggcggcgagccgcagacagtacagatagtacggaaccgattcacttggtgcttcagcaccttagagaatcgttctctttgagctaaggcgaggcaacgccgtactggtttttgttaatccactataaactgcccgcctgtgagtggcggggcagggaatctgtgtgcggattatgccataaaacggtgtccgacccaatcgcgggcgcgtccggagattggaaatcctgcttaaaaaatgtacaatggcgtacttttttgaaacgcggatccattatgcacatcggcggctattttatcgacaaccccatcgcacttgcgccgatggcgggcattaccgacaaaccgttccgccgactttgccgagattttggcgcaggttgggcggtgtgcgaaatgctgaccagcgacccgacgctcagaaatactagaaaaaccttgcaccgcagcgattttgccgatgaaggcggcattgttgccgtgcagattgccggaagcgatccgcagcagatggcggatgccgcgcgttacaacgtcagccttggggcgcagcttatcgacatcaacatgggctgtcccgctaaaaaagtctgcaatgtccaagccggtagcgcgctgatgcagaacgagccgctggttgccgccattttggaagccgtcgtccgtgcggcaggcgtacccgttaccctcaaaacccgtttgggttggcacgacgaccatcaaaacctgcccgtcatcgccaaaatcgccgaagattgcggcatcgccgcccttgccgtccacggacgcacgcgtacgcaaatgtacaaaggcgaagcgcgttacgaactcatcgccgaaaccaaatgccgtctgaacatcccggtctgggtcaacggcgacattacttcgccgcaaaaagcccaagccgtcctcaaacaaaccgccgccgacggcattatgatagggcgcggcgcgcaaggcaggccgtggttcttccgcgatttgaaacattatgccgaacacggtgttttgccgcctgccttgagtttggcagaatgcgccgccgctattttgaaccacatccgcgccatacacgcgttttacggcgacaccgccggtgtgcgcatcgcacgcaaacacataggctggtacatcgacgaaatgcccgacggcgaacagacacgtcgtgaaatcaaccgcttggacagtgcggcggcgcaatacgacatgcttgcaggttatcttgaaagacttgccgaaaaaaccgacagttgggcgtgcgcctaccgcccaaatgccttctgaacacttgattatcctttgaaagtgcaatcatgccccatacccttcccgatatttcccaatgcatcagacaaaatttagaacaatatttcaaagacctgaacggtaccgaaccttgcggcgtgtacgatatggtattgcatcaggtggaaaaaccgctgctggtgtgcgtgatggagcaatgcggcggcaaccagtccaaagcatccgtgatgctggggctgaaccgcaataccctgcgtaagaagctgattcaacacggtttgttgtgaatatggctgcaagcgtccgtatcttaggcatcgacccgggcagtcgcgtaacgggtttcggtgtcatcgatgtcagggggcgggatcatttttacgtcgcctccggctgcatcaaaacgcctgccgatgcgcctctggcagacaggattgccgtcatcgtccggcacatcggcgaagtcgttaccgtttacaagcctcaacaggcggcagtggaacaggtgttcgtcaacgtcaatccggcatcgacgctgatgctcggtcaggctaggggcgcggcattggcggcattggtcagccataagctgcccgtttcggaatacacggccttgcaggtcaaacaggcggtagtcggcaagggcaaggcggcaaaagaacaggtgcagcatatggtggtgcagatgttgggactttcgggaacgccccagccggatgcggcggacggtcttgccgtcgcgctgacccacgccttacgcaaccacgggcttgccgccaaactcaatccttcggggatgcaggtcaagcgcggcaggtttcaatagtttcagacggcatttgtattttgccgtctgaaaagaaaatgtgtatcgagatgaaatttatattttttgtactgtatgttttgcagtttctgccgtttgcgctgctgcacaagattgccgacctgacgggtttgcttgcctaccttctggtcaaaccgcgccgccgtatcggcgaaatcaatttggcaaaatgtttttccgaatggagtgaggaaaagcgtaaaaccgtgttgaaacagcatttcaaacacatggcgaaactgatgttggaatacggtttatattggtacgcgcctgccggacgtttgaaatcgctggtgcgctaccgcaataagcattatttggacgacgcgctggcggcgggggaaaaagtcatcatcctgtatccgcacttcaccgcgttcgagatggcggtgtacgcgcttaatcaggatatcccgctgatcagtatgtattcccatcaaaaaaacaagatattggacgaacagattttgaaaggccgcaaccgctatcacaacgtcttccttatcgggcgcaccgaagggctgcgcgccctcgtcaaacagttccgcaaaagcagcgcgccgtttctgtatctgcccgatcaggatttcggacgcaacgattcggtttttgtggattttttcggtattcagacggcaacgattaccggattgagccgcattgccgcgcttgcaaatgcaaaagtgatacccgccattcccgtccgcgaggcagacaatacggttacattgcatttctaccctgcttggaaatcctttccgggtgaagacgcgaaagccgacgcgcagcgcatgaaccgttttatcgaagacagggtgcgcgaacatccggaacaatatttttggctgcacaagcgttttaaaacccgtccggaaggcagccccgatttttactgactacgtaaaattacaaaacatatcaggcgtttcgagtcgaaactcctgattgtttttttaaatgcaaaatggcagattatatgaacagatttcatttgataatcgctgctatttaagtatctcaaaaacaatatttttaagacttggtcgggaaattcgaagcaggttttggaagaaataccgcaaacctatgaatatatgcagacaatctagttaatatattaaaattaattttctttaaaaacatagcgttataaataaatatttaatatatgcctttcatgtttactttaatatttgacattttatgcttaaatttaaatataaatcaaaattaaatttatatttattgaaatataaaaaataaaaatccatatatttaatattttcagcaattttataaaattaatgttttgacatttatattgtaaaaaatgcttggcaaagcgtagaaaatggcgtacatttcgctacatggaattacacgacaggcaggaaatgccgtctgaaaggattttccggtcagtcttgcgattggtcggggtttcatcggaaacggtgaaacgaaagtttgccggcgtagagttgagctacgcgggtaaagccgcaggcgaaagcctgtattgtttgtgaagcgtaaatctctgatttgaggtattggggcaatcctgtggggggttgcctctttttttatccgccttttaatgacacaataggtgcatccgttttaaatacaaggtgctgtcatgaccacgattttggctttcgatattgaaaccgtacccgatgtgcagggtatccgaacattgtacgagctgccgtcctcgctgcccgacgatsaagtggtgctgtttgcccagcamaaacgccgtgctcagacgggcggcgattttatgcagcatcatcttcatcaggttgtggcgatttcgtgctgcatgcgttgggggcaggataaagtacatgtcggcaccatcggcgagatggatgacggcgaggaagtggtcattgctaaatttttcgaattgattgaaaaacatacgccgcaactggtcagttggaacggcggcggtttcgatctgcccgtactgcattaccgctccctgatatacggcatcaacgccgcgcgctattgggatatgggcgacggcgatttcggcgacagccgcgatttcaagtggaacaactacatcagccgttatcaccaacgccactgcgatttgatggatttgctcgcgctttaccagccgagggcaaacgtgccgctggacgatatggcgaaactgtgcggttttccgggcaagctgggtatggacggcagcaaggtttgggaggcattccatacgggcaggctgaaggaaatccgcaattattgcgaaaccgacgcggcaaacacttatctgatgtacctgcgtttctgtctggtcagcggcaggctggatgcggacgaatacgaaatggaaatcaaacggatgcggaattacctgtccgcacaagccggggaaaagccgcattgggaagagtttgtccgcgcgtgggaataaagattgaattcaaaccggttgtccggcggcgcgcccgtgccgccgctgcggcttcagacggcatacgcgggatgcgcccgtgccgtctgaagccttttccagtcaaacaaaataacattgaaagaaaaaaatgagcaaaaccgtgcattatctcaaagactatcaaacgcccgcctaccatattctcaaaaccgatttacattttgatattaatgaaccgcaaaccgtcgtgaagtcgcgtttgacggttgagccgcagagggtaggggagccgctggtgttggacggttcggcgaaactcttgtccgtcaaaatcaacggggcggcggcggattatgtgttggaaggagagacgctgacgattgcgggcgtgccgtccgaacgcttcaccgtcgaagtggaaaccgaaatcctgccggcggaaaacaaatcgctgatggggctgtatgcttccggcggcaatttgtttacccagtgcgagccggagggcttccgcaaaatcacattttacatcgaccgtccggatgtgatgtccaagttcaccaccaccatcgtcgccgacaaaaaacgctatcccgttttgctttccaacggcaacaaaatcgacggcggcgagttttcagacggccgccattgggtgaaatgggaagacccgttttccaaaccgagctatctgtttgctttggtcgcgggcgatttggcggtaacggaagactatttcaccaccatgagcggcagaaacgtcaaaatcgagttttacaccaccgaagcggacaagcccaaggtcggctttgccgtggaatcgttgaaaaacgcgatgaaatgggacgaaacgcgcttcggtttggaatacgacttggatattttcatggtcgtcgccgtgggcgatttcaatatgggcgcgatggaaaacaagggtttgaacatctttaacaccaagttcgtccttgccgacagccgcaccgccaccgataccgatttcgaaggcatcgaatccgtggtcggacacgagtatttccacaactggacgggcaaccgcgtaacctgccgcgactggttccagctttcgctgaaggaagggctgaccgtgttccgcgaccaagaattttccggcgaccgcgccagccgcgccgtgcgccgcatcgaaaacatccgcctgctgcgccagcaccagttccccgaagacgcaggcccgaccgcccatccggtgcgccccgccagctatgaggagatgaacaatttctacaccatgaccgtttatgaaaaaggcgcggaagtagtgcggatgtatcacaccctgctcggcgaagagggcttccagaaaggcatgaagctctatttccaacgccacgacggacaggccgttacctgcgacgatttccgcgcggcgatggcggacgcgaacggcatcaatctcgaccagttcgccttgtggtacagccaggcgggcacgcccgttttggaagcggaaggtcgtctgaaaaacaatattttcgagttgaccgtcaaacaaaccgtgccgcccacgcccgatatgacggataaacagccgatgatgattcccgtcaaggtcgggctgctgaaccgcaacggcgaagcggtggcattcgactatcagggcaaacgcgcgaccgaagccgtgttgctgctgaccgaagccgaacagaccttcctgctcgaaggcgtaaccgaagccgtcgttccctcgctgctgcgcgggttcagcgcgccggtgcatctgaactatccgtacagcgacgacgacctgctgctcctgctcgcccatgacagcgacgccttcacgcgctgggaagccgcccaaacgctctaccgccgcgccgtcgccgccaaccttgccacgctttcagacggcgttgagctgccgaaacacgaaaaactgcttgccgccgtcgaaaaagtcatttcagacgacctcttagacaacgccttcaaagccctgcttttgggcgtgccatccgaagccgagctgtgggacggcgcagaaaacatcgacccgctgcgctaccatcaggcgcgcgaagccttgttggatacgcttgccgtccacttcctgccgaaatggcacgaattgaaccgtcaggcggcgaagcaggaaaaccaaagctacgaatacagccccgaagccgccggctggcgcacgctgcgcaacgtctgccgcgcctttgtcctgcgcgccgaccccgcgcacatcgaaaccgttgccgaaaaatacggcgaaatggcgcaaaacatgacccacgaatggggcatcctgtccgccgtcaacggcaacgaaagcgatacgcgcaaccgcctgctggcgcagtttgccgacaagttttcagacgacgcgctggtgatggacaaatattttgccctcgtcggctcaagccgccgcagcgacaccctgcaacaggttcgaaccgccttgcagcatccgaaattcagcctcgaaaaccccaacaaagcccgttcgctcatcggcagcttcagccgcaacgtcccgcatttccacgcagaagacggcagcggctaccgcttcatcgccgacaaagtcatcgaaatcgaccgcttcaacccgcaggtcgccgcccgcttagtgcaggcgttcaacctctgcaacaagctcgagccgcaccgcaaaaacttggtgaaacaagcattgcagcgcattcgggcgcaggaaggattgtcgaaagacgtgggcgaaatcgtcggcaaaattttggattgaggccgtcaaacagaaaaacaatgccgtctgatatagttacacacacgttttatcatcacttccccatcgttttattacgcaatggcaaaacggccgcaaagtcatattaattatagtggattaacaaaaatcaggacaaggcgacaaagccgcagacagtacagatagtacggtaaggcgaggcaacgctgtactggtttttgtgaatccactatattgctagaagtgcaccgattaaggttaattaaaatacgacccttatcccaatattaagaaaaacagcaatcaaaataaacttgattgctgtttttcagtttaagccatgaatgtgattaggctccttatgcagatggcgttaccaataacggctgctgtacggattgtatattggcatccacatttcctcctgtcgcagcagtattagaaccgaacacagacatagactgtaccaaattattgccagcattaatatacttggcaaaatctggattactgatagctgcatcatcaaagacaaatgtatctacacgatggttttcaccatagaaaaatccggaaatacgtacgttgtcttgttcagaagcgctaagcaccaaatcacttccggaacggataaaatgaacatctgctgctttaaatcctttaaagtgcatagtgtcagagtttttatccacatggtaattatagaccgtatcctgaccgaagccttcgccgaagacataagtatccgaaccgctgccgccctccaagtaatcattgcctgcaccgccgatcagagtgtcgttaccgtcttcgccgttcaaatgatcattgccttcgccaccattcagtgcatcgttaccattatagccgtacagggcgtcgttgccttctcctccatcgagcgtatcattgccattgccactgtagatactgtcgttgcctgcatcaccattcagcaggtcatccccgtcggcaccgtacagatagtcatcgcccaatccgccatttaaggtacttccggattggtaggcatacaatctgtccgaaccgtcggtggattgctgtaccagttctttgacagtggcaacatccagtactttgccgttatcgaaatgaatctcatcgatacggtaagcacctgagccatcgttctggaaataggactgaacagtcacttgtccactgccgtcttttgccttgataagaagatggttgccctctcgggtaaaagtcagcatatcggctgtaataccgtcggtaaagcggatgatgtctttgcgtccggtagcgtagtcgtaattatagaccgcatcctgaccgaagcctttgccgaagacataagtatccgaaccgctgccgccctccaagtaatcattgcctgcaccgccgattagagtgtcgttgccatcttcgccgttcaaatgatcattgccttcgccaccattcagtgcatcgttaccattatagccgtacagggcgtcgttgccttctcctccattgagcgtatcattgccattgccactgtagatactgtcgttgcctgcatcaccattcagcaggtcatccccgtcggcaccgtacagatagtcatcgcccaatccgccatttaaggtatttccggattggtaggcatacaatctgtccgaaccgtcggtggattgctgtaccagttctttgacagtggcaacatccagtactttgccgttatcgaaatgaatctcatcgatacggtaagcacctgagccatcgttctggaaataggactgaacagtcacttgtccactgccgtcttttgccttgataagaagatggttgccctctcgggtaaaagtcagcatatcggctgtaataccgtcggtaaagcggatgatgtctttgcgtccggtagcgtagtcgtaattatagaccgcatcctgaccgaagcctttgccgaagacataagtatccgaaccgctgccgccctccaagtaatcattgcctgcaccgccgattagagtgtcgttaccgtcttcgccgttcaaatgatcattgccttcgccaccattcagtgcatcgttaccattatagccgtacagggcgtcgttgccttctcctccatcgagcgtatcattgccattgccactgtagatactgtcgttgcctgcatcaccattcagcaggtcatccccgtcggcaccgtacagatagtcatcgcccaatccgccatttaaggtatttccggattggtaggcatacaatctgtccgaaccgtcggtggattgctgtaccagttctttgacagtggcaacatccagtactttgccgttatcgaaatgaatctcgtcgatacggtaagctcctgagccatcgttctggaaatagtactgaacagtcacttgtccactgccgtcttttgccttgataagaagatggttgccctctcgggtaaaagtcagcatatcggctgtaataccgtcggtaaagcggatgatgtctttgcgtccggtagcgtagtcgtaattatagaccgtatcctgaccgaagcctttgccgaagacataagtatccgaaccgctgccgccctccaagtaatcattaccggcaccgccgatcagagtgtcgttaccgtcttcgccgttcaaatgatcattgccttcgccaccattcagtgcatcgttaccattatagccgtacagggcgtcgttgccttctcctccatcgagcgtatcattgccattgccactgtagatactgtcgttgcctgcatcaccattcagcaggtcatccccgtcggcaccgtacagatagtcatcgcccaatccgccatttaaggtatttccggattggtaggcatacaatctgtccgaaccgtcggtggattgctgtaccagttctttgacagtggcaacatccagtactttgccgttatcgaaatgaatctcatcgatacggtaagcacctgagccatcgttctggaaataggactgaacagtcacttgtccactgccgtcttttgccttgataagaagatggttgccctctcgggtaaaagtcagcatatcggctgtaataccgtcggtaaagcggatgatgtctttgcgtccggtagcgtagtcgtaattatagaccgtatcctgaccgaagccttcgccgaagacataagtatccgaaccgctgccgccctccaaatagtcattaccggcgccgccgattagagtgtcgttgccgtcattaccatataaagaaacatttttattatgaccaaagcctacattttgcaggatatcatctgcttgcgtacccgatgttttagctaataatgcaacggtctcctgacccaacactttctggtaatcttcaaatttacctgctttttttgcctcctccacataatcggtcattagtcttcggccttcataccaagaacgaagttcgccatatgcaagcatctcggccaaatccacaaaagctttttgcggattagtttctttgacatggttaaatgcttgaacaagaccactaaaatccaaagtgaacgtatcattttccattttgaaactgatttgattcaaatatggctgcaaacgggtttggaacaacaggttttggtagatgtttttggcgagatggtcgtatgtatcgttggttactttgacgatattaagcgcatcttcctcgctcatgtaatagagtgtgttggaatcctgccccgtgtaggcatcaagcacggcaatgcggtcgcgggcggcgtcaatagctgctttagctttatcagaaagggaaactaaagcgttcttttttagttgtgctacttgggatggtgtcagtgcaataccttcattagccgtttgcgtccaatcggttgaaagtcgcattggcgattttttgccccagttcgaatcggtttccgcccatttgtgaatcaaattatctaacaatgccaactgtgcttctttagtttcggcggcagaataagctttcagcatattggccaaatcgccggacaatgcggcagcttcgcgcaaatcgcgcagacggccaatgcccgcaagattggcggcttttgcctgttcggcagtgagttccactttgtctttgaagcggctgtgcagattgtcggctgctaaaagtaaatcccccatttttgcggttgtaccgtctgttttggtatagctgccttgctgagccaaagtgttaccgttaccgagatttttatttacatctttataggcgagatccaaagattggatacccaattcttcaagggtacgcaattcattagcttgggaaatgccgtcctgattgagatcctgccatacacgcagggtttggaatgcggcgtctgccgcgttgatgatgttgtcgccgtttgaatccaattcggccaaagccgcgtagccgtgtttggcaaaagaaccgtctgccagtttggtgttgtcgccgaagagttccgcaccgttgtcgatgatgccgttgccgttcaaatcgcggacgagtaaaccgtcatcggcagaaacccaaccggtggcggtgcggataccgttgttggtgtgatcaaataagctgcctgcaaagcctttggtggcaacggtttctataccgtcgccatctaggtctagggcaagggggtcgtagacatgatatttgccattgcgttttttagtttctttaacccaaggagctaaacattggtgaccatcatcgatccagccttccggatttgggaacagatctctaaatttttcggccagatctttaaaactgggcaagcccttaaaaaattctcgagctgcttgagcagccttctcggctgtggatttggcattttcgtatgcttctttggcggcttgagccaaatcttccactacttgtttagctttctctgctgaaccgtcagccaaatcggaagcagcatttttcattttttcagacaattctttaatggctttgacacctttttctattccttgactagtattgtctactatgtcattatagattatttcggcagcctgagtgagattattccactgtgtatttaagtcatctccaaattccttgccagcagctttcatatcatgaaccaagctattgatttcatttttaaaagcttcatttccttgcttgatgttattattaacgatctcaaatattccagtccactctctttttacaacacttttatataaatcattgattatcccattaccccaacctccaattttttgccaaccatctattgtatattcaacacctaactttgttacatccatcatcacagattgtaaaaaagtaaaatgcttctctttaaaagatccatcaaatcctttatctaaagcagatattaactgctttctattatccctttcgctaccgttcggattatttactgcttgctcattgtggatacgttcggcttctatccccaaacctaatgcccaataaccatccgccatatccggaagtgaacgattaataactaaatcaatagctgcactggaagaaacgccattatcggtaacggctttatagtaacttctctcaatttcactagtattgggtaatctaccattattttgattaattagacgcgcatattgcctgaaatgttgcagtgcaacccgatcaaatttctctaaacgggtctttttaccgaccgtatcatcccataggttttccacaccttttttcatccataaattcaaaccatttaagtttgcatccttaccgacaattgcagcagcatcatccgcataacggtcacccaaattagccaaataacgccaaccgccataggtatcgccacgggaagcataaccacgcaaggtttggatttgttctggtgttaaaacaacttcaccctcattcatartaagatcctttaaattattttttacttgaattgttgacaaaactctgtaccaattgctctacttgttggtgttaac

SEQ ID NO: 37827 - DNA, 16878 bp, Neisseria meningitidis
ggattaacaaaaatcaggacaaggcgacgaagccgcagacagtacagatagtacggaaccgattcactcggtgcttcagcaccttagagaatcgttctcttttttgttcatccgctatattgtgttgaaacatcgccacaaacctgatatagtccgctcctgcaacatcattgaaaattgttctttttaatcagttaaaaccgaatacggagtcgaaaatgaatccagcccccaaaaaaccttctcttctcttctcttctcttctcttctcttctcttctcttctcttctcttctcttctcttctcttctcttctcttctcttccgcagcgcaggcggcaagtgaagacggcagccgcagcccgtattatgtgcaggcggatttagcttatgccgccgaacgcattacccacgattatccgcaagcaaccggtgcaaacaacacaagcacggtaagcgattatttcagaaacatccgtgcgcattccatccacccccgggtgtcggtcggctatgatttcggcggctggagaatagcggcagattatgccagttacagaaaatggaaagaaagtaattcttctactaaaaaagttactgaagagataaacaacaactacaaagaaacccaaacaaaacatcagggaaacggcagcttccacgcctcttcttctctcggcttatccgccatttacgatttcaaactcaacgataaattcaaaccctatatcggcgcgcgcgtcgcctacggacacgttaaacatcaagttcattcggtggaaaccaaaaccacgattgttacctctaaaccaacgcaaggcgctgcacagggaggtcctattatacaaactgatcccagcaaacctccctatcacgaaagccacagcatcagcagcgtgggtcttggtgtcatcgccggtgtcggtttcgacatcacgcccaagctgaccttggacaccggataccgttaccacaactggggacgcttggaaaacacccgattcaaaacccacgaagtctcattgggcatgcgctaccgcttctgattccccgataccgatgccgtctgaaccttcagacggcattttttacacaattcccaccgtttcccatcattcccgatacaccgtaatctcgaaacccgtcattcccgcgcaggcgggaatccagacctgtccgcacagaaacttatcggataaaacggtttctttagattttacgtcctagattcccacttccgtgggaatgacggttcagttgcattcccgacaacaacgcaatctcgaaacccgtcattcccgcgcaggcgggaatccagacctccgacgcggcgggaatctatcggaaatgactgaaaccccgagattctagattcccacttccgtgggaatgacgtggtgcaggtttccgtatggatggattcgtcattcccgcgcaggcgggaatccagacccccgacgcggcgggaatctatcggaaatgactgaaaccccgcgttctagattcccacttccgtgggaatgacgtggtgcaggtttccgtatggatggattcgtcattcccgacaacaccgtaatctcgaaattcgtcattcccgcgcaggcgggaatccagccccctgacgcggcgggaatctatcggaaatgactgaaacccccgagattctagattcccacttccgtgggaatgacgtggtgcaggtttccgtatggatggattcgtcattcccgcgcaggcgggaatccagacccctgacgcggcgggaatctatcggaaatgactgaaaccccgcgttctagattcccacttccgtgggaatgacggttcagttgcgctccgacaacaccgtaatctcaaaacccgtccgacaacaccgcaatcttgaaattcgtcattcccgcacaggcgggaatccagacctgtccgcacagaaacttatcggataaaaacagttgcccaaaccccgcgttctagattcccactttcgtgggaatgacgtggtgcaggttccgtatggatggattcgtcattcccgcgcaggcgggaatccaaacccccgacgcggcgggaatctatcggaaatgactgaaaccccgagattctagattcccactttcgtgggaatgacggttcagttgcgttccgacaacaccgtaatcttgaaatccgtccgacaacaccgtaatcttaaaacccgtcattcccgcgcaggcgggaatccagacctccgacgcggcgggaatctatcggaaatgactgaaaccccgagattctagattcccacttccgtgggaatgacgtggtgcaggtttccgtatggatggattcgtcattcccgcgcaggcgggaatccagacccccgacgcggcgggaatctatcggaaatgactgaaaccccgcgttctagattcccactttcgtgggaatgacggttcagttgcttagggtaggatttggcgggattggcggactgaagcccactctacagccccgccctacaatacgccttgcgaatctgttccgcgcccgcccttgtatgtctcaaatgggttaaactacacacttcccgacttcccgtttcgggcaggggtgcaggttcgatttatatttcaataaaacaaggaaactttatgcagcacgaagaaggcaaccgccaacgccctcaaggcgaactgctcctgcgtaccgtcgctatgccgcgcgataccaatcccaaccaagacattttcggcggctggattatgtcgcagatggatttgggcggcggcatattggcggcggaaatcgcgcggggacgcatcgttaccgtcgccgttcaggaaatgaacttcatccgcccggtcaaggtcggcaacgtcgtctgctgctacgggcattgcgtccgcgtgggcaacacttccctccagcttaaagtcgacgtctgggtgaaaactttgatgaacgattgcgttaccgaagaccgctacctcgtaaccgaagccgtgttcacttatgttgccatcgatgcggaaggcaatccgcgcccgattccgaaagaaggcaaccccaaattggcgggcttattgcctactccgtaaaaatacccgtaaaaatgccgtctgaaactgtcttcagacggcattttgcatcatttgaaccaggacctgatgcgggaaaacagcgacatactctgtttttcaaagtcttcccgcacttcgggcacggctttttttatcactttcattcctgcaaaagtctgcgccacgggcataatttcaatcgtgttcacattcatatgcgccggccgctggtacagccacaatgcggtttccgcaatatcttcggggcggataaattccacaccctcatacacgcccgccgccctctcgtcatcgcctttgaagcgcacattggaaaactccgtattgccgcacaaacccggctcgatattggtaacgcggatgttcttatccgccaactccgcgcgcaaattcaggctgaactggcgcacaaacgccttggtcgccccgtaaacgttgctgccggcataagcataattgcctgcaatcgaacccaaattcatcacataaccgccgccgcgttccaccatttgcggcaaaattttgcgcgtcaggaacgtcaaacccaaaacattggtttgaatcatcgtttcccaatcttcaaaatccgccttgtccgccgtgtccagacccaaagccagcccggcattgttgatgaggcagtcgatgtcggaaaattcatcggggatgccgtttaaggcgttttccaccgactcgcgtcgcgacacgtccatttccaaagggtaaaacaaagcacccaattcatccgccaaggcctgaagcctgtccgcacggcgcgccgcaccgataacgcggtatcccgccccgacaaacgcacggcacatcgcttcgccgaatcctgccgaagcaccggtaattaaaacagccattgtttttcctttctttctcgtttcccaaacctgtttcaggtatcataacacccttcagacggcatcgcgccgactgaaaatgacaacaaccataccaccacgacaggacacattcaatatgaaaacccaaatcagccttgctgctgccgccatcacactgctcctttccgcctgcggaggcagcggaataccttcccaacccaaaggcgaaatttccgaaaaccgcaccgccgcgttcaaatccatgatgcccgaattcacacgcatgggcaaaatggtcaaagacgaagaaccttacgatgtcgaaaaattcaaacaggcggcagcgtcgtttgccgaaagcagcaagaaaccgttcacactttttgagtccgatccgcaaggcaacggccgcgcactgcccgccgtttggtcggatggtgcaaaatttgaagccgaaaaaacaaaattcgccgccgccgtcgaaaaactcaacgccgccgcccaaaccggcaaactggacgaaatcaaagccgcctacggcgaaaccggcgcaagctgcaaatcctgccacgacagtttccgcgcgcccgaataacatccaaaacaaaacaatgccgtctgaagacttcagacggcattttctttgccatttcagcacacgcaaagcaatcagaaattatcgtcaatccaaatgaaaaaacgctatccttatttttaccccacgcactccgccattttctattttgatttgctatgcgattaatttttatcgtcaaatgtcaaaatcgggatgccggattgggtaaacagggcatacaccggcttgagccaataatcttccggaagggaagccggtttcaatgcgtaaacgtgcacattgggaaaatccttcatcgtcaacgccgcgccgctgaaaaaggtataaatttcatacctcgtatgcgggtttttcttaatctcgcgcaaaatatagtcttcgatgacatagggcgaatttaatgtggttacgccggaaagcccgtaggtttggcggggatgcggcgcgacatattgtattttgaagttttttgccgccttttccgaaatttccttcatctctttgtcgggcgaacccaaaagtatccgcaccgtgccgcccgtttcgtcccccgtcttcagttcggacgcatcgaacagcggcaggtaagtcatcttgcggcggccgtcgtccataatgtttttcaaacccttgaatatcgtgtaatgctcgtcggaagcattgcgggttttggcgatgctccaatctccgatcatcatccgggcaaaattccgcttgatcgtcccgtttacagaaaactcatcgcccaaatagctgctgctttgaattaaattgcctgtcccgtcgtcaaaggttttgatttccgcatccgggtaagtgctcaaaaaggcggcaatgctgactttttccaaacttgccaaataaatccgcttgactttcggcagcagcatcgactttaccttcagctccgccatcgtcggaatgaaattaaacgatttgttcaaaccgtagggcaggtggaaaaagtacgcccgctccgccttatcctttatctgattgaaataataatcgtatttttcattcctgttttcagacatcagcaccacataaaaccgctcgcccggatgctgcgccataatcctttccgccaccttcatctgcaatatggtataacagaaaatcagattgaccggttccccctcttcattgaaaagtttctccttcagcagggaaaccgcattcctttccccctgatttacccggtcaaatgtataaaatatcccgaaacaaaaaacaatcaaacacaacacggtcaaacaagcctttttcaagcccatatccctaaaactccattccgacaaattgaacatacgccccgagtgtcccgggacggaaaaatgcggaattttagcagatattccgacagttaccgaatattatagtggtttaaatttaaatcaggacaaggcgacgaagccgcagacagtacaagcagtacgacaaggcgaggcaacgctgtactggtttaaatttaaaccactataaaatcaatttcaccgaaaatatgccgccgcacatcaggcacagcacctccgaccgccgccaaacgcgggaaaaccatttcccccttcctttcacgccgccgcgttcaaacacgccaagatcgaacaaagcgcgaacaaagccgccaaaatatgccataatagccacgcacattccccgcgcaatgtgttccaaaagaaaaaaccaacctacaagagaataatcctatgactcaaaaatccaccattgtttatacccataccgacgaagcacccgcgctggcgacccaatcgctgctgccgattgtgcaggcttttgcccgccacgccgatattgatgtcaaaaccagcgacatttctctctccggccgtattttggcggcgtttcccgaatacctgaccgaagcgcaacgcgtacctgatgcgcttgccgaattgggcgaactggtgaaacaacccgatgcaaacgtaatcaaactgccgaacatcagcgcgtccgtaccgcaactgactgccgcgattaaagaattgcaatctaaaggctttgccgttcccgactatcccgccgacccgcaaaccgatgaagaaaaagccgtacgcgaacgctacgaccgcatcaaaggcagcgcggtaaaccctgtcctgcgtgaaggcaactccgaccgtcgcgcccctaaagcagtgaaaaactttgcgaaaaaaaatccgcacagcatgggcgcatggaccaaagactccaaaacccacgttgccaccatgcaaagcggcgacttttttcataacgaacaatctgttatcgtacctgaagcgacttccgtatccatcgtattcaccgacaaacaaggcaacaaaaaagagctgcgcgagcccgtcgccctgaaagccggcgaaatcatcgacgcgaccgtgatgagtaaaaaagccctgctcgccttccttgccgaacaagtaaaagatgcgaaagcaaaaggcgtgttgttctcgctgcacatgaaagccactatgatgaaagtgtccgacccgattatcttcggacacgccgtcaaagtattcttcgcgcctgtttttgaaaaattcggcgacaaactggctgctgccggcgtcaacgttaacaacggcttcggcaacctgcttgccaatctggacaaactggatgcggacacccgcaccgccgtcgaagccgaaatcgccgccgtttacgctgccaaccccgatttggcgatggttgattccgacaaaggcatcaccaacctgcacgttcccagcgatgtcatcgtcgatgcctctatgcctgcgatgattcgcaattccggccgtatgtgggacaaaaacggcaaagcgcaagacaccaaagccgtgattcccgacagcagctatgccggcgtttaccaagcaaccatcgacttctgccgcgaacacggcgcatttgacccgacaaccatgggtactgtgcccaacgtcggactgatggcgcaagcggcggaagaatacggctcgcacaacaaaacctttgaaatcgaagccgacggccaagtccaagtcattgatgcggcaggaaaagtcctaatgcagcacgacgttgaagccggcgacatctggcgtatgtgccaaaccaaagacgctccggttaaagactgggtacaacttgccgtcaaccgcgcccgtctgagcaacacgcctgccgtgttctggctcgacgaaaaccgtccgcacgacaagagcctgctcgccaaggttaaagcctaccttgccgaactggataccaatggcctcgacatccgcgtcctcgctcctgaagaagccgccaagttcagcttgggtcgtctgaaaaacggcgaagacaccatctccgtaaccggtaatgtcttgcgcgactacctgaccgacttgttcccaattttggaactcggcacaagcgcgaaaatgctgtctatcgttccattgatgaacggcggcggtatgtttgaaaccggcgcgggcggttctgcaccgaaacatgttcaacaattcctcgaagaaaaccatttgcgctgggactcgctgggcgaattcctcgcactcgccgtatcgtttgaacatttggcgcaaaaaaccggcaatgccaaagcccaagtcctcgccgacactttggatgcagccaccgaaaaactgctgttgaacgacaaatcgcctaaacgtaaagccggcgaactcgacaaccgcggcagccatttctacctcaccctctactgggcgcaagaattggcggcgcaagacaaagatgccgaactgaaagccgcatttacgccattggcagccgctttgaccgccgacgaagcgaaaatcgttgccgagctttccgccgtacaaggcaaagcggccgacatcggcggctactacgccgccaatcctgaaaaagccgcacaagtgatgcgtccgagcgtaacctttaatcaggcactaaacgccttataagcacaaaggtaaaaatgccgtctgaacattcgtcgttcagacggcattagttatccctatctgcctgattatgattaaacgccgcacccattggatataaaaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactataaagaccgttgggcatctgcagccgtcattcccgcgcaggcgggaatctagtctgttcggtttcagttattttcgataaatgcctgttgcttttcatttctagattcacactttcgcgggaatgacgaattttaggtttctgattttggtyttctgtccttgtgggaatgacaggatgtaggttcgtaggaatgacgtggtgcaggtttccgtgcggatggattcgtcattcccgcgcaggcgggaatccagaccttaaggcagcggcaatattcaaagattatctgaaagtctgagattctagattcccactttcgtgggaatgacggttcagttgctacggttactgtcaggtttcggttatgttggaatttcgggaaacttatgaatcgtcattcccgcgcaggcgggaatctggaatttcaatgcctcaagaatttatcggaaaaaaccaaaacccttccgtcatcattcccgcaaaagcgggaatctagaaatgaaaagcaacaggaatttatcggaaatgaccgaaactgaacggactggattccctcttttgcgggaatgacggcgacagggttgctgttatagtggatgaacaaaaaccggtacggcgttgtctcgccttagttcgaagagaacgattctctaaggtgctgaagcaccaagtgaatcggttccgtactatctgtactttctgcggcttcgtcgtcttgtcctgatttttgttaattcactatatcgacatcgccaaacgaaacttcgtcatcgccgtttcgtctttgtctaaaaccaaaaccgaaaccaacaaccccaaaggtatcgcccatactatcgaataccttaaaaaacacaaggtcgagacctttgcaaaattccccaaaatcccctaaattcccaccaagacatttaggggatttctcatgagcaccttctttcaacaaaccgcccaagccatgattgccaaacacatcgaccgcttcccgctattgaagttggaccaggtgattgattggcagccgatcgaacaatacctgaaccgtcaaaaaacccgttacctccgagaccaccgcggtcgtcccgcctgtcccctgttgtccatgttcaaagccgtcctgctcggacaatggcacaacctctccgatcccgaactcgaacacagcctcatcacccgcatcgacttcaacctgttttgccgttttgacgaactgagcatccccgattacagcaccttatgccgctaccgcaaccggctggcgcaagacgacaccctgtccgaactgttggaactgattaaccgccaactgaccgaaaaaggcttaaaagtagagaaagcatccgccgccgtcgttgacgccaccattattcagaccgtcggcagcaaacagcgccaggccatagaagtcgatgaagagggacaagtcagcggtcaaaccacactgagtaaggacaaaaatgcccgttggacaaagaaaaacagcctctacaaactcggttacaaacaacatacacgtaccgatgcggaaggctatatcgagaaactgcacattactcccgccaatgcccatgagtgcaaacacctgtcgccgttgttggaarggttacccgaaggtacgaccatctatgccgacaaaggctacgacagtgcggaaaaccggcaacatctggaagaacatcagttgcaggacggcattatgcgcaaagcctgccgcaaccgtccgctgacggaaacgcaaaccaaacgcaaccggtatttatctaagacccgttatgtggtcgaacaaagcttcggtacgctgcaccgtaaattccgctacgcccgggcggcctatttcggactgatttgcgcccgctgccgcctaaaaggcagcccggatgcctgattatcgggtatccggggaggattaagggggtatttgggtaaaattaggaggtatttggggcgaaaacagctgaaaacctgtgtttgggtttcggctgtcgggagggaaaggaattttgcaaaggtctcaacttgaacaaaaaagaaccgccccgaatcagggcggttttgctttgtggcggaaacggtgggattcgactaaattttatttcattgatttaaatatatttatttcttatgaaaatttaatttaccataaaaacagccatatacaaaaatcttggagtaactattgcattacactattagaagaatgccgtctgaagtgttttcggacggcatttcccaagctgccggaaaaaagctaaaatgcccgcaaacagacaaggagcagcgatgcaaaaccaaaatacacgccccgtcaaaatcgagcttaaaggcgaagcaggcaaacgcgtactgcttgccgccgcccgccgcattgccaaaacccatcaaaaagccgtcaaggcacttgccgacaaatgatagacggcgaactggtcgcgcttatccatcaaaccgtattggcggatgaagcgggtttgaaagggcgggcggatatggcgcgcttggacggcgcattgtcgcggattgccaactggcggcagtatgaaaaccttgaggacatctacgaaatcgccgccctctatgcacaagccatagccaaagcccacgcctttcccgacggcaacaagcgcaccgcgcttttaacaatgttgacctatctggatttgcagggcatcagcattgccgccgaccaagggcttgacgacttgattgtcagtttggcggcgggagaaaccgacttcaaacagctcgccgaaaccctgcgccggctggataaggaataggcatatccgacaacaatgccgtctgaaattcagacggcatttttattgaaaggcttttcttcaaccgctttacacaaaggcggtttttttatgccgtctgaaagcccttcagacggcattggtttacacggcaggagtccccccgcctttaagcaggagaggatgtcaaggatgcctgatttttaaatcaccccttgaaagaacgggcgcacggcattaatatacagatatcgacaagcaaggttaaaaccattaaggaaatacgatgaaatacaaaaatgagggttttaatggctggtaaggtgcggaaacaaataaaacaaggaggttggttgtcagtaattgccctaacctccttgtttgtatctgtattcactttattttacatattcaggcacagcgtacagtttaacctatgagggacggccgaatggctgatgttttggcaactgaccgttgtttcagtaaccgccgtcattgcactggggacaatattcatcaataagaaaacttcaaagcaaaaggcgacattagatgttattttgaatgattaccaagatgcacaatttgtagaagccgacaatcatatttcgccttatattcgcggcacggcagttgacgacaacaacgcgcggatcgacctgtatgaaatttatcaaaataagggcggacaatgggaaaaagagagagggcatttacttaccgtaatcaatcggcacgagttttatgcgtgcgcaatcaactcgggagtattggatgaggatttgtttaaacggctgcattgcaccaacttcataaaattgtggaatgcagtttcgcctcttgttatgaaaatacgcgaagaagaacgcaaagacacaatatttagagagttggaaattttggttgcattatggaaagcaaaccccctaaaggcatctgatttgtgaataaacagtcaaaactgttctgaaatatgggcagccacgcaatcgccgaaatacgccaaagcagccttataaagtgattttttgaacataattttctccttgcggagcattttccaatcaaacagttttagtttacttggttttgtatccctaaacaaccgaaatccgacatcaagcaattagaaagcttttgcatcttgaaaatggataacaaaatattgcctgaaggcgcaaatacagtacaaaagccgtccgaaacagttcggacggcttttggcgtattctgcacaagtatttgaacaactgaaattttatggtaatatgtatctactttgtagatacaataaaggtgaagattatgttgcgtgtccaaaaatgggggaactcggcggccgtccgactgcctgccgacatgctgaaacaattggattttaaaatcggcgacgctttggtagcggaagtacataacggcgaactccgtgtgcgtgctgcccgacgtttccgcttggcagacttgcttgccgaaatggaagaaaccccgccgcgcgtagaaggctgggaaatcttggatgatgccggcaacgaggtcgtctgaaatgtatattcccgacaaaggcgatattttccatttgaatttcgacccttccagcggcaaggaaatcaagggcgggcggtttgcgctggctctgtctccaaaagcattcaaccgcgcaacgggattggtttttgcctgccccatttcacaggggaatgcagcagctgcacgaagcagcggcatgatttcaaccttactcggtgcaggaacggaaacgcagggcaatgtccactgccaccagctcaaatctctagactggcaaatccgcaaggcttcttttaaagaaactgtacccgattatgtattggacgatgtgctggcgcgcatcggcgccgtcttattcgattaaatgctgaaaccgcccgaacctgtaatcttttcttacaggttcgggcggttgcttattcggcacgctgactgcttactgcatgaccatatgcctgccattcccttaaatcggctgcatgtccgtcggctgtttctgccagtcctgcatatttttcagcgcactgtccgaataatagccagccttgggaatctgacgcgccatcagatgcggtggcggcggtagcggttgcgggcaggtttctgttgcgattttgggcggcggcgtagtggcgcaggcggttaagctcaagacgcatagcggcaacagttttttcagcattttgtttttcctcttctaatttggtttgtcgttcggcaaacgcggcagcggccttctgctcggcagaacgcgcctgctttgcctgctcgatatagccgtctttcagacgattcgagatttcggcagcagcagcctcccgtcccatgcggtatttttcggcacggtcgaaatgccatgcggtaaaaatcaggacgattagcagcaatacacctaccggcttccagtatttcaataaaatatccatttcagacgacctcaaggatgcagcccgggcagatacacggttttgccgtttttcttggttgcggtcagtatctggttgcgttgcgggctgttgcgtcggaaaccgatgtgtacccatgcgccgtccccgcgctcaggaaattcgagtatcaactggtcgaatttcagcgcacggcggattcgcatttgaagtgcaactttccctaacagaaaaaggccagtatgcggtagcatacggcctttcctgcaagaaagattgccatgagccacacgcaactgacccaaggcgaacgataccacatccaatacctgtcccgccactgcaccgtcaccgaaatcgccaaacagcttaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacccccttatccgccgcaaactcagtcccgaacaagtatgcgcctacctgcgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttaggacattaaaggcacataaagacagggtgcacaccatcaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaagcaatattaaaaattatcgtcatcaatgcggcttccccagcccgcggcgagctttccacgacaggctttttttatttgggttggtcgtctggtttctttgagttcaaaaacaggtcgggatacttaagttttattcgtgcaggtatcccgcgcttcgtccaattgaaaacgcattgagggctattccctgttattcgaccaacttccgcgtaactgccgattgattgcaacaggcgtttgtcttcattgactcttttatccataaataaaccaaatgtttaaatctaatgctaatattaaacactatgtttagataaaaatcaagtcttgtgtaacaacattttgtttaaatatgggagaataattaagccaaccgcgaataagattaaaaatgacaatgcacgagacaactgacagactttttgagatagccaaagagcagggagttttaaagccggctgacatagcagagcgtctgatatcagccaacaggctttgaaaaactgggaaagtcgtggcatagcggcaaaggcgctgcctgaagtagcaaaagcattcggtgtatctgaaacatggctgagaacaggtgaaggcagccgaaccgcgcccgtccttattgaccccgacctaccccacgaagtcaaagacatccaccgcccgatgacgtggagcagcaacgacccgctgcccgacgatgattatgttttcgtcccctacctcaaagagagctgcttcaaaggcggagtaggcacgtatgaaatccccgattacaacggctaccgcctgccgttcggcaaatccacgcttaaacgcaaaggcatcaatcccgacaacgtgttttgctgcaccctgaccggcgacagtatggaggaaaaaatcgcagaagacgcggcaattgccgtagatacgggcgaaaccgccatacgcgacggcaaaatctacgccttcgcccaggacggtatgttccgcgtgaagtacctgatacggcagcctggcaacagcgttctgatacgcagccacaacagcggtttctatggcgacgaaaacgcccccttggacagcctgaccgttatcggcagggtattttggtggagcgtgctggattgaaaaatgttgctattacgacgagataatattgatagggctttcaagattgtcaaaaataggcgttttgattccccttggtggcctggtgagtacgatgccggtatgaatttccttggcgtacaaggagagttgaaggttcacgagctgcatcacagaacagcaaccctgtgctttgagtggcttggcgaagtatctgcgccgcgcagaaaagagaactacaaagacctcaagccaaatgtattgtatgactttgatggttccggtaagcattttgccaaccctgacgcaaggtatctattgcccgtcggttcaagcggcttaatcttaaaacatatccaaatcgatgacgaagacactctgttgcggctatggtgcgcacgaaatatcccaatgccacaccggctatctaaaatcccgatgcttcggcagtattatctaagcaaggcatggcacgaaatttatgctatcaaccaacacctaaggaaaacgaagctgatagttgatgtggcatacgaccccacagattaaacaacccgcccgcattatgcgggcttttttcatgccccgccgaacctgaaaacaacacaaaaccgacatagccgcgtacc

SEQ ID NO: 37828 - DNA, 4169 bp, Neisseria meningitidis
ccgtcttttgtgctacccttgcccgaatcatccgatgtctaaaaattctgcctgatggcagccctacaaacccgaaggagtagaaatgaaactgtccgaactgttcaaccccgacgaatttgccgcgcggcatttgagttttggcgacgaagcggcgttgcttgccgctgtcggcgagaaaagtatggacgattttgtcggcaacaccgtgccgcaaagcatccgtatgccgtctgaactcgatttgcccgatgccctgaccgaagcggacgcgttggcaaaattgaaaggcattgcgtcgaaaaacatgatcaacaaatcctatatcggtttaggctattacccgacccgcgtgccgaacgtgattttgcgtaacgtattggaaaatccgggttggtacaccgcctacacgccgtatcaggcggaaatcgcgcaggtcgtttggaagctttgttgaacttccaacaagtgtgtatcgatttgaccggtttccctgtggcgggcgcgtctttgctggacgaagcgaccgccgccgccgaagcgatggcgatggcgcaccgcgtgggcaaggtaaaatccgagcgtttctttgtggacgagcgcgtgtatccgcaaactttggacgtgatgaaaacccgtgccaagtatttcggcttcgagctggtggtcggcgattttgcccaagccgacgaaggcgaatacttcggcgcgctgttccaatacgtcggcaaagacggcgacgtgcaagacttgcaggacgttatcggccgtctgaaagccaaaggcacgattgtcgccgtttccgccgacatcatgagcttggttttgctgaaaccgcctgccgaattgggtgcggatattgcgttgggcaacacacaacgcttcggcgtgccgatgggcttcggcgggccgcacgccgcttatttcgcgtttaaagacgagttcaaacgttccgccccgggccgcatcatcggcgtatccaaagacgcatcgggcaaacctgccttgcgcatggctttgtccacccgtgagcaacacatccgccgcgaaaaagctacatccaatatttgtaccgcgcaggcattgctggcgaatttggcgggtatgtatgccgtttaccacggccctgaaggcgtgaaacgcattgccaaccgcattcacgcgctggcttctgcctttgccgatgcgctggtttcagacggcctgaatgtggttcacaaagtctttttcgatactgttaccatcgattttggcagtaaagagaaagcagaccaagtgtttgccgctgctttggcgtcgggttacaacctgcgccgcgtcaacgatactcaagttgcggctgcattccatgaaacatcggcatacgaagatttggtcgatttgtaccgcgcgtttaccggcaaggatacgtttacatttgccgatgatgtcaaaggccgtctgaacgccgaattgctgcgtcaggacgacattctgcaacatcctgtgttcaacagttaccacaccgaacacgaaatgttgcgttatctgaaaaaactcgaagaccgcgacttggcgatgaaccgcagtatgatttcattgggcagctgtactatgaaactcaacgcgactgcggaaatgttgccgattacttgggccgagttcaccgacatccatccttacgctcccgaagcgcaaaccgccggctaccgcgaattgctcgccgatatggaaaacagcctgaaagccatcaccggctttgacgcgatttccctgcaaccaaattccggcgcacaaggcgaatacaccggtatgctcgccatccgccgctatcaggaatcccaaggcgaagcgcaccgcaacatctgtctgattccaaaatcagcccacggtaccaaccccgccaccgccgccatgctcggtttgaaagtcgtcgtcgtcgacaccgacgaacacggcaacgtcaacattgacgatttgaaagccaaagccgagcaacaccgcgacgctttgtctgccatcatgattacctatccgtccacccacggcgtgtacgaagaaggcatccgcgacatctgccgcattattcacgaaaacggcggacaggtttacatggacggtgcgaacctcaacgcccaaatcggcatcatgcagcctgccgaagtcggtgcggatgtgttgcacatgaacctgcacaaaaccttctgtatccctcacggcggcggcggcccgggcatgggtccgattggcttgaaagcccatttggctccgtttgccccgggccataccttgaccgacacccacaacgcggctgccgatcaaaccgccgtggctgccgcagcatatggttctgcatccatcctgccgattacttggatgtacctgaccatgatgggcaaacaaggcatggaacaggcaacgcgctgggcattgctcaacgccaactacgtcgccaaagccttgggcgaggattatccgattctctacaccggcaaaaacggccgcgtcgcgcacgaatgtatcgtcgacttgcgtccgctcaaagccgaaagcggcattaccgaaaccgacatcgccaaacgcctgatggactacggcttccacgccccgaccgtctccttccccgttgccggcacgctgatgatcgaaccgaccgaaagcgagagcaaagccgaactcgaccgcttcatcgccgccctgaaacaaatcaaacaggaagtgctgaaagtcgggcgcggcgaatggccgaaagacgacaacccactggtcaacgcgccgcacaccgccgcagatataaccggcaactgggcgcatccgtattcccgcgaagaagccgtcttcccgttgccgttcgtccgcgaacacaagttttggcccttcgtcaaccgcgtggacgacgtgtacggcgaccgcaatctcgtgtgcagctgcccaccgatggaaaattatgaagactgactgttgatatcttaaaaaatgccgtctgaaacattttcagacggcattttcatcaacggcaaaccagttgcaccaatacacgtatctcgactataactttaaaacaaatgagttaaaccagtatccatacatcagcttttttatcatcctactttttattcatccgatcgtgcaaacagatttcaaagatgaaaagcctattcacaccctttgatgtcatttccacacggacaaacaaatatagtggattaacaaaaaccagtacagcgttgcctcgccttagctcaaagagaacgattctctaaggtgctcaagcaccaagtgaatcggttccgtactatttgtactgtctacggcttcgtcgccttgtcctgatttttgttaattcactataaattcccataaaaaaacggagcagatacctgccccgtttttatttaatccgaaattttaatctaaatttagaattttgcaccggattggtttgccatatagtcaacagccgctttgacttcgtcatcgctcaaacctgcattgccgcctttggcaggcatcgcgttaaagccttcaagggcgtgtttgtgcaaggtttctttgccttttttgatacgcggtgcccaatcgtcttttttgcctatgccgggaataccgggaatcgaaccgccgtggcacacctgacaggttgcttcgaagacttttttaccgtcaacgccgaccgcaggggctgccgcacccttgtcttctgccttcgcttctgccggagctgcactatcggcaggagcagaagctgttcctgaagcggcattgtcggcaggcgcagcctcatcaggattcgggaaagaaccgccgcttttgttcgccatgtaagtaatcgcccgtttaagttcctgatcggtcaggtctgccgcaccgccttttgcaggcatggcgttaaagccgttcagcgcgtgttggaacaaggtatcgaagccttgcgcgatacgcggtgcccaatcgccgttgtgttccagtttcggagcgttcggcacattgctgtccgccgcgtggcattggatacagattttgccgaaaatctgttcgccttggcgttcgccgacggggatgccgtcgcccatcgtcaattgtccgacaggctggatacgggtctgcgttgctgcttccgtagtggcatcgacatcgccgaacgagccgctgcccgccagcttaatcaggaaataaaggactgcaataac

SEQ ID NO: 37829 - DNA, 15896 bp, Neisseria meningitidis
  misc_feature (22)..(22): N is any nucleotide
tgtgttgtttgcaccggttgcntgcggataatcgtgggtaatgcgttcggcggcataagctaaatccgcctgcacataatacgggctgcggctgccgtcttcacttgccgcctgcgctgcggaagagaagagaagagaagagaagcggagaggaggggaggggaggggaggggaggggaggggaggggaggggaggggaggagaaggttttttgggggctggattcattttcgactccgtattcggttttaactgattaaaaagaacaattttcaatgatgttgcaggagcggactatatcaggtttgtggcgatgtttcaacacaatatagcggatgaacaaaaaagagaacgattctctaaggtgctgaagcaccgagtgaatcggttccgtactatctgtactgtctgcggcttcgtcgccttgtcctgatttttgttaatccactataaagaccgtcgggcatctgcagccgtcattcccgcgaaagtgggaatctagaaatgaaaagcagcaggaatttatcggaaacgaccgaaaccgaacggactggattcccgcctgcgcgggaatgacgggattttaggtttctgattttggttttctgtttttgagggaatgacgggatgtaggttcttaggaatgacgtggtgcaggtttccgtgcggatggattcgtcattcccgcgcaggcgggaatctagaccttagaacaacagcaatattcaaagattatctgaaagtctgagattctagattcccactttcgtgggaatgacggttcagttgctacggttactgtcaggtttcgtttatgttggaatttcgggaaacttatgaatcgtcattcccgcgcaggcgggaatctagaccttagaacaacagcaatattcaaagattatctgaaagtccgagattctagattcccacgaaagtgggaatccaggatgtaaaatctcaagaaaccgttttatccgataagttcctgcactgacagacctagattcccgcctgcgcgggaatgacgggattttaggtttctgattttggttttctgtttttgagggaatgacgggattttaggtttctgattttggttttctgtccttgtgggaatgacgggatgtaggttcgtgggaatgacgtggtgcaggtttccgtgcggatggattcgtcattcccgcgcaggcgggaatctagaccttagaacaacagcaatattcaaagattatctgaaagtccgagattctagattcccgctttcgcgggaatgacgaaaagtggtgggaatgacggttcagttgctacggttactgtcaggtttcggttatgttggaatttcgggaaacttatgaatcgtcattcccgcgcaggcgggaatctagtctgttcggtttcagttatttccgataaatgcctgttgcttttcatttctagattcccgcttttgcgggaatgacggcgacagggttgctgttatagtggattaacaaaaaccagtacggcgttgcctcgccttagctcaaagagaatgattctctaaggtgcttaagcacgagtgaatcggttccgtactatccgtactgtctgcggctcgccgccttgtcctgatttttgttaattcactatatcgcgatttttcggcatttgcctttcggggcggcttgtgtctcgtgcgtgatgttgcgtgtgggaatgttcggattgtcagaagcaatatgggagaagatgatgtatgagataaaacagccttttcatagcggatacttgcaggtgtctgaaattcatcaaatttattgggaggaatcgggcaatcccgacggtgtgccggttatttttttacatggcgggccgggcgcgggggcttcgcctgaatgtcggggttttttcaatcccgatgtgttccgcatcgtcatcatcgaccagcgcggttgcggacgttcgcgcccgtatgcttgtgcggaagacaatacgacttgggatttggtggcggatattgaaaaagtccgtgaaatgctgggtatcgggaaatggctggtgttcggcggttcgtggggcagcactttgtcgctggcttatgcccaaacccatcctgaacgggtaaagggattggtgttgcgcgggatatttttgtgcaggccgtctgaaacggtgtggctgaacgaggcgggcggtgtgagccggatttatccggaacaatggcaaaaatttgtcgcgccgattgctgaaaatcggcggaaccggctgattgaggcgtatcacggattgctgtttcatcaagatgaagaagtgtgcctgtctgccgcgaaggcttgggcggattgggaaagctatctgatccgtttcgagccggaggaagtggatgaagatgcttatgcctcgctggcaatcgcgcgtttggaaaaccattattttgtcaacggcggttggttgcagggcgatagggcgattttgaacaatatcggcaaaatacggcatatcccgactattatcgtacaggggcggtatgatttgtgtacgccgatgcagagtgcgtgggcgctgtcgaaagcctttcccgaagcggaattgagggtggttcaggcagggcatcgtgcgttcgatccgcctttggtggatgcgttggttcaggcagttgaggatattttgccccatttgttgtaaaaagttccgcataaaaaagcagcttctgtttggaagctgcttttgttttgaatggtttaacgcagttcggaatggagtttgcccaataatgcggatgcgtctttgccggcatatgcgctgccgtctttgttgagcaggacgatgcgcgagccgttggcgacaggttctgcatagacaatcagttccggctgttcggcaggtttctccgctttgcctttgcccagcaggcgtttgaacaggccgggtttttgttcggtaactgcattgctttcgttcggggctttttgaaccaggaaggcgtggcgttcggtgttttgaccgacgacggtcagcccgatgcggtcgagggcgagcacggtgcgccgccagtttctgccgtagtcgccaaagacaatcaggcttttgccttcgatacgcgccatttcgttggcggcgggaagggtaggtttttttgccgatgcgttttccgcctgctgtccgtcaacgcccaaatattgcataaagcgcgtcaggaaagcggcttcgaggttgggatcggacggggagggctgccatacggtcgtgtctttgtctttgccgccgtacacttctttcatggctttgtgggcgaagaagatgtcggaaacgccgtttttgccctgttcgatacggacgatgaatttgtcgcgctcgccggtggagtagatgccgcccaagccgactttgtcgaagaggcggcgcaagctgtcttgggggattttggcgcggttttccgcccactcggtttccatttgtccgatggcgggttcttcggatttgatgtcgaagccgttttcctgccaaaaggctttcaggagcggccagatttcggcaggagacttgccgtcgacaacgagccagcgttggctgccgtcgcgctcgaggcggacacctttgacgcttttcaatacttcggcatcggcaggctgttggacggcgggtgtgcggcgtttttccaaatcgctggcgcggacggcgcccgaaccggcaggcaggcggtagaggttgccttggtcggggttgttcaaatcaggtgggacttcaagtttgatcaggcggtgcgaccggctttggtagtcgagcttgggctgttcggttttgctgccggagcaggcggcaagcccgatgagtgcgagcgcggcaatgacgggtttgatatgggtcatcgtgtcatcctgtgtgatggatattaaagtgtttgttgcgttatgccgtccgaacggttcggacggcatggctatatttaaagttgtcctgaggctttcagggcggcgcggacttttgcttgtccgttttccgtcagcggaacgagcggcaggcggacgtgcggttcgcatctgcccagggcggataccgcccatttcggtgcggcggggctgggttcgcagaacatggtgtcgtaaatcggaatcagtcggtcgttgagttcgcgtgcaagggcgatatcgccttgaagcgcggcgcggcacatatcggcaaagagcttgggcgcggcgttggcggctacggtaatcacgccgtgtccgccgcagagcatgaacggcagggcggtgtggtcgtcgccggaaaggacgacgaagccttcgggcgcgcggttgatgagttcgatgttgctgccgatgttgccgctggcttctttcacgccgacgatgttggggatttcggcaaggcgcaggatagtgtcgttagtcatgctgacgacggtacggccgggcacgttgtagataatcatcggaatcgaagtggcttcggcgatggttttgaaatgttggtaaatgccttcttgggagggcttgttgtaataggggacgacggagagggtgtagtccgccccggctttttcggcggcttgggaaagggcgatggcttcgacggtgttgtttgcccctgtgccggcgatgacggggacgcgtttggcaacgtgtttgacgacggcttcgatgacggcggtgtgttcttcgacggagagggtggcggattcgcctgtcgtgccgacggcaacgatgccgtccgtgccgttttcaatgtgccagtcgattaagtcgcggagttgttcgtaatggatgctgccgtcttgattcatcggggtaatcagggcaaccaagctaccttgtaacatacagaaccttttatcagttgtggtgtaggggcggtaatgcttccgattgtagcctactttaccgcaggtgtgaaatccggcgggttgcagatgtggggcgtttgcgccgaaaggtatggtggaaattgatttttcctgtttgaaatcattttattatattcgccggtttatgccggtgccgtcggatttatagtggattaacaaaaaccagtacggtgttgcctcgccttagctcaaagagaacgattctctaaggtgctgaagcaccaagtgaatcggttccgtactatttgtactgtctgcggcttcgccgccttgtcctgatttttgttaatccactataaaatgtggtaaacgtgtggaccagacggatgccgtctgaaatgcaaattgaagccgtgcggcagattcgctacaatccgcgcttggatttttcaacctttaaaataaggaaatacaatgagcggtcagttgggcaaaggtgcggatgcgcctgatttggtgtacggtttggaagacaggccgccgttcggtaatgcgctcttgagcgcggttacccatcttttggcgatttttgtgccgatgattacgcccgcgctgattgtgggcggcgcgctggaattgccggtggagatgacggcgtatctcgtgtcgatggcgatggttgcgtcgggtgtcggcacttatttgcaggtcaaccgcttcgggccggtcggttcggggatgctgtccatccagtcggtgaatttttcgttcgttaccgtgatgattgcgctgggcgcggggatgaaagagggcggtttgactaaggatgcgatgatttcgacgctcttgggcgtatcgtttgtcggcgcgtttttggtgtgtttctcggcgtggcttctgccgtatttgaaaaaagtgattacgccgacggtcagcggcgtggtcgtgatgctcattggtttgagtttggtacacgtcggcattaccgatttcggcggcggcttcggcgcgaaggcggacggcacgttcggctcgatggaaaacttggggctggcatcgctggtgttgctgattgtgttggtgttcaactgcatgaaaaacccgctgttgcgcatgagcggcattgcggtcgggctgattgccggctatatcgtcgcgctgtttttgggcaaggtggatttttccgcgctgcaaaacctgccgctggttacgctgcccgtaccgtttaaatacggttttgctttcgactggcacgcgtttattgtggcgggcgcgattttcttgttgagcgtgtttgaggcggtcggcgatttaaccgcgacggcaatggtgtccgaccagccgattgaaggcgaggaatacaccaaacgcctgcgcggcggcgtgttggctgacggcttggtgtcggtgattgcgacggctttgggttcgctgccgctgacgacgtttgcgcaaaacaacggcgtgattcagatgaccggcgtggcttcgcgccatgtgggcaaatatattgccgtgattttggtgctgttgggtctgttccccgttgtcggtcgcgcgtttacgacgattccgagtccggtgttgggcggcgcgatggttttgatgttcggcttaattgcgattgcgggcgtgcggattttggtcagtcacggcatccgcaggcgcgaagcggtgattgcggcaacgtcggtcggtttgggcttgggtgtcgcgtttgagccggaagtgtttaaaaacctgcccgtcttgttccaaaactctatttccgccggcggcattacggcagtcttgctgaatttggtcttgcccgaagataaaaccgaggcggcggtcaagtttgataccgaccacttggaacactgattttgaaaatgaatgccgtctgaaacagaatccctgtttcagacggcattgtttttgaggcttatactttttcgttttttaatacgcgttgtcggcgtgtttcacttaataccattccggcagacacggagacgttcatgctttcgactgtgccgaacatgggtatagacaccagcatgtcgcaatgttcgcgcgtgaggcggcgcataccgtcgccttcgttgcccattacccacgccgcgctgtcgggcagattgcaatggtaaaggtcggactcgccgctcatatcggtgccgataatccaaatgccgtattctttcaattcgcgcagggtgcgggcgaggttggttacggtgatataggggacggtttccgccgcaccgcaggcgactttgctgacggtggcgttcagccccgcgcttttgtctttcggtgcgatgacggcgtgtacgcccattgcgtcggcggtacgcaggcacgcgccgaggttgtgcggatcggtgatgccgtcgagtatcagcagcagcggcggttcgctgaggttttccaatacgtcttcgaggtggacgtggtttttggaggcatcgataaatccgaccacgccctgatggcgcgcgcctttgctgatggcgttgaggcggtcggcatcggcaaaatatacgcggatgttttcgtttgccgccttttccaacacttcgcgcgtgcgtgcgtctgatttgccttcttggatgtagagttcgacgatggatttggggttttgccacaatcgggcgttgacggcgtggaagccgtagatgggtctttggtttgccatgatggtgctttgtaaaaagggttcagacagcattatagcaatttgccggtatgccgtctgaaagggttaaaacaggtaggcgatgtatttcaccaacaggataaacaagatggatacggcgcagccgattttgaacgccgtgccgacgacaagccccaacagcgtacccaagcccgctttacctgcctgaagcatattgcgccgttcgatcagttcgcctgccgccgcgccgataaagggaccgagtattagtccgggaagggagaaaaatatgccgatgatgctgccggccaatgcgccgcgaacggcgagcttgcccgctccggtatattttgtcccccatatgcctgccacatagtccgccagtatgccggcaaggctgatgagtccgaccgtccacaaaacgcccgcgccgtagatttggtagccgccggcataggcaagcagccatgttccggcaaacatcaatgccaatccgggcagggcggggtaaacgatgcccgccgtgccgacggctatcagggcgagggcgaggatgacggtcagtacggtcataggttcaaccttttcttttgttttgaaaaaaacggcttaacacggcgcggcattcttcttgcaggattccgccccgtatggcggtgtgcgtattgaggcgtttgtcggcaaacaggttgacgatgctgcctgccgcgccggttttgggttctgccgccccgtagatcacacgcctgattcgtgcctgtatcagtgcggacgcgcacatggcgcagggttcgagggtgatatatatgtcgcatccgtcaaggcggtagttttgtatttctctgcctgcctgtgccaaggcgttgatttcggcgtgtcggctgacattgcagtcggcaatgcaggtgttgtgtgccgatgcgatgattttgccgtctgaaacgatgactgccccgacgggtatttcgccgtcggcggaggattgttctgcttggcgcagtgcttcgcacatgaagtgttccatttcttcctgcggcggaaaggcggcgacgggcggatggttttttaactcggcaagcaggcgggctttatgcgcttgggacatttcttgcggcggcgtgccgtccagcagcgactcgagttgccacagtgtgcttttcgtgagggtcaaacccgatgctttgagcagcagaaaggctttgaccgaaccgttttgccgcagttcttcgagtgtacggataccgagcctgtgcagggcggcgacggttttgggggcgagcggcggtgtggtcagcatggtttatgcgccgaaaaaccgttttgccgcctcaatcaggcgtgtgcatgaagtgcagtctgaaaacgggtcggcaacgcagtctaaaggtgttttgcgcaaccaagtcagttggcgtttggcaagttggcgggtggcggcaatgcctttctcgacaaatgccgggaaatcggtttttccatccagatatttccatgcctgacggtagccgacgcagcggatggcgggggagtaggcggtcaggccgggatagcggcggcgcaggttttctacttcgccgataaagccctgttcaagcatcaggtggaaacgcagggcgatgttttcatgcaggcgggcacggttttcgggaatcagggcggcggtatgcaaatcaaaagggagcgtatgggaggtcaggctgccgagatgtgtgctcatcggtttgccggttaaataataaacttccaaagcgcgtccgatacgctggctgtcgttcggtttcagacggcatgcggtttcagggtcgactttttgcagggtgcggtagaggaaatccaagccgtacatctgtttttgttcgtccaagtcggcacgcaggcaggcgtcggcttcgggcaaatcgttcaaaccttgggtcagggcgcggaaatacatcatcgtgccgccgacaataagggcaaacctgccgcgtgaggaaatttccccgaccaagcgcgtgcagtcttcgacaaagcgggcggcgctgtatgattcggtaggcgggatgatgtcgataaggtggtgcgggacaaaggcgcgttcggaggcggacggtttcgccgtgccgatgtccatatcgcggtaaaccagcgcggaatcgaggctgatgatttcgacaggcagggtttcggcaattttgagggcgagcgcggttttgcctccggcggtcggcccgagcagggcaaaggctttcggggtcggcataacgtttcaggtttggaaaaatacggattatagcggaaagcgtgccgacgttatattttggtttgcggaagcacgccgacggcaagggggcgtgtttaccgtatgcctttatatagtggattaacaaaaaccagtacggtgttgcctcgccttagctcaaagagaacgattctctaaggtgctgaagcaccgagtgaatcggttccgtactatctgtactgtctgcggcttcgtcgccttgtcctgatttttgttaatccactataaaatttcaaaccgacgcgccgggttttcaatatgcccgcgcccgatgccgccttgtccgcaggcatcagcggcagtgtccgattttttggggaatgcccgtcccgggcgtatttaaaggttcggcggtgcggcgttttcctgcggcaaggcttcagacggcatctctggtgcgtccgttagacaaggcgtgcgcttggggcgataatggcgttttgcttttttgaaagccttgcaatgtcccgaaacctgcttgtccgctggcttgccgtctgcctcatcccgttggcgacgcttgccgttttcgccgccaatccgcccgaagacaaactccagcatctgatcaacggcatcatccttgcctgcgaagcgacgtttttgtttaaattcgtccttttcgacaccatcaagcatcatttgaaacaagagtttgatttgaaacgtcaaactatgttgctgtttattccgattattttgctgattgtgtatttgttccactattttggcgcgttttagcccgtttccgttatttctatgaatactcctccttttgtctgttggattttttgcaaggtcatcgacaatttcggcgacatcggcgtttcgtggcggctcgcccgtgttttgcaccgcgaactcggttggcaggtgcatttgtggacggacgatgtgtccgccttgcgtgcgctttgccctgatttgcccgatgttccctgcgttcatcaggatattcatgtccgcacttggcattccgatgcggcagatattgataccgcgcctgttcccgatgtcgtcatcgaaacttttgcctgcgacctgcccgaaaatgtgctgcacattatccgccgacacaagccgctttggctgaattgggaatatttgagcgcggaggaaagcaatgaaaggctgcatctgatgccttcgccgcaggagggtgttcaaaaatatttttggtttatgggtttcagcgaaaaaagcggcgggttgatacgcgaacgtgattactgcgaagccgtccgtttcgatactgaagccctgcgagagcggctgatgctgcccgaaaaaaacgcctccgaatggctgcttttcggctatcggagcgatgtttgggcaaagtggctggaaatgtggcgacaggcaggcagcccgatgacactgttgctggcggggacgcaaatcatcgacagcctcaaacaaagcggcgttattccgcaagatgccctgcaaaacgacggcgatgtttttcagacggcatccgtccgcctcgtcaaaatccctttcgtgccgcaacaggacttcgaccaactgctgcaccttgccgactgcgccgtcatccgcggcgaagacagtttcgtgcgcgcccagcttgcgggcaaacccttcttttggcacatctacccgcaagacgagaatgtccatctcgacaaactccacgccttttgggataaggcacacggtttctacacgcccgaaaccgtgtcggcacaccgccgtctttcggacgacctcaacggcggagaggctttatccgcaacacaacgcctcgaatgttggcaaaccctgcaacaacatcaaaacggctggcggcaaggcgcggaggattggagccgttatcttttcgggcagccgtcagctcctgaaaaactcgctgcctttgtttcaaagcatcaaaaaatacgctagaatagcgcgttttacgacaaccgatttgattggaaaatcacaatgaaaacagcacaagaactgcgcgccggcaatgtatttatggtcggcaacgatcctatggtcgttcaaaaaaccgaatacatcaaaggcggccgctcttccgccaaagtcagcatgaaactgaaaaacctgctgaccggcgcggcttccgaaaccatttacaaagccgacgacaaattcgacgtggtcatcctgtcccgcaaaaactgtacgtacagctactttgccgacccgatgtacgtctttatggacgaagaattcaaccaatacgaaatcgaagctgacaacatcggcgacgcgttgaaattcatcgttgacggtatggaagaccaatgcgaagtaaccttctacgaaggcaaccctatctccgtagaactgcccaccatcatcgtgcgcgaagtcgagtacaccgagcctgccgtcaaaggcgatacttccggcaaagtgatgaaaaccgcccgcctggtcggtggcaccgaaatccaagtgatgtcttacatcgaaaacggcgataaagtcgaaatcgacacccgcaccggcgaattccgcaaacgcgcctgatttgccgcattgaaaaatgccgtctgaaaacgtttcagacggcattttttttatattcgccccgtgtttggattgaagtagatgtttttttcgtaaacgacaatacgcgtgattttgccattttcgtcaaaatggatgtctaaaaacggtttgtcgggattgcgttcacggttggacagccggaagagtgattggttttcaagcatttctccgtgtattttcagatagccgggcaattggctgatgtattggaaattgccgccaagtccgttgttgtgccggctcgaataggcaggggttgccgaaacttcaaaataacgcgtgcgtttcggctcctcgccttgtccgcgggtttcttgactgccctgtatcagcaacagcgtcgcttctcggaggcggcgttcctgttccatcaaggcattttgtgcctgccggctgatcgtgcgctttccgtaacgcaagtcttcaattgccagtatgattttctgatggtagtcgggatcttcagggcggatgtcgggaaacagcagccgctgtatgttgtcatagccaccgtcgggtaagccgaaacgggtttccagttcgtgatgggaaagggcaaacagacagtccgagtcaatgtgttcggcgatttgctgcatgagatcgtcaatgccggtggcggggtgcaggctggtgcaatttgacggcggcgcgctttctgcctgcttgacgttatcaggggcggatgcggtcggttgcaaatcggtttgggaaggagctgatgacgcggaggacgaagcagcggatgcaccgacttctttggttttatcgtctttgctcggagaacacgcggtcagcatgattgcggtaagccataagagaagtgatgaggttttgtttttcattctattgtttccagtattaaagaggccgtctgaaaacctaccgtttcatttttcagacggcctgttgttaatagaaccgaagaacctgttaatgccgacaaggttctcaacctgtcttacccgacgcggtaaaacgccaggctgcccaaaaggttggggaaatgtttgacctgtctgttgcccgtcatcacggcgcgctcgaggatgcggatgttgtttttggcgcacaataaatcaaagtctttgagcgtgcaccaatggatattgggcgtgtcgtaccaatggtagggcatacgttcggaaaccggcatatgtccgccgagtgcgatttggacgcggttgcgccagtagccgaaattcgggaagctgacaatcgcctgtttggcaacgcgcatcaggcagcgcaggattttttcggtattctgcatcgcttggatggtttggctcaacacaatcacatcaaaactttgatcgttgaatgcggttaaaccttcttccaaatcggcttggataacatttacgccgcgcgacatcgcggcgatgacgctatttgtgtcgatttcgatgccgtagccgctgcattttttgtgttcgaccaatgcggcaagcagttcgccgtcgccgcagcccaagtccaagacgcggctgccttcgggtatccggtcgtaaatcagttgcaaatcatcgcgcaggttcattgctgacattccttataaacgttgttcatataggcggcgaccgcacgcatataggcttcgtcttccattaaaaaggcatcgtgcccgtgtgcggatttgacttcgatatactgcacggatttttgggcggcaatcagtgccttgaccagttcgtgcgaacgttcgggtgcgaaacgccagtcggtgctgaagctggcgacaaagaatttcgctttcacattttgcagggcgcgggtcaggctgtcgccgaaatctgccgccggatcgaaatagtccaaagccttggtcatgagcaggtaagtgttggcgtcgaaccgtccgacgaatttgtcgccctgatagcgaagataggattccacttcaaattcaacaccaaagccgtattgataaccgttggaacgcaaatcgcgtccgaattttttgcctaaaccgtcttcggcaagataagtgatgtgtcccatcatgcgggcaatccgcaagccccgtgcaggaacggtattgtggctgcggtaatgtccttcattgaaatcagggtcggtcaaaattgcctgacgcgccacatcgttaaacgcgatattttgcgtggacagtttcggcgcagacgcaatcactaaagcatggcgcacgcgctcgggataggaaatcgtccactgcaaggcctgcataccgcccaagctgccaccgacaatcgccgcccattgttcgataccgagatagtcggcaagcgcggcttgggattttacccagtccttcaccgtaaccaccggaaaatccgcgccgtattccctgcccgtttcaggattaatcgacaaaggcccgctgctgccgtcgcagccgcccagattattcaaaccgaccacgaaaaaacgttccgtatcaatcggtttgccaggtccgaccatattgtcccaccagcccgtatatttatcttccgccgaatgcctgcccgcaacatgatggttgcccgacagcgcgtggcagattaaaaccgcattgtttttttcagcattcagctcgccgtaggtttcaatcatcagatcgaaacgcggcaaagttttaccgttttccaaaaccagcggcatctcaaacggaattttttggggcattacaatgcccaccgaggcattttgactcatatcctgttccaacaaatgcggcgaaaagcgttattatatcgcaaacggcatgactttttgacacggtcggacaagcagccggacgcgtttgaccctcatccgccgcacacgaatcatactttttcagacgacctccaccgcttcccgacatgataggcagacttttccgtatttttttctttttcgcacttgccgcgttgattatcaaccgccttttcagccgcaggcaaaaacgcgccctgcgcgaagtcgccgaaatcagcgcatgggtactgctcggtgcagccgccgcgatgctgttttggtatctgtttatgctgtatttcaaacacattccggattcgtattgacggaaaaaatgccgtctgaaacgcatttttctgtttcagacggcatatttgatgaaaagggcttgcggtaggaggtgctttatagtggattaactttaaaccagtacggcgttgcctcgccttgccgtactatttgtactgtctgcggcttcgtcgccttgtcctgatttttgttaatccactatacaaccgaagcaggaagggcagggggtcagcgttggcgcgctttaaaacgcggattgcttttgcagatgacgtaaactttgcccctgcgcctgacgatttggcagtcgcggtggcgttgtttggcggttttgagtgaagacagaacctgcattatttgtcctttctaaacgatgacattacggattggaaacgttggttgaatttgctggcacggccttcggtgttgacgttgcgctgtttgccagtatagacgggatgggatgcggaagaagtatccagcgaaaacagcggatattctttgccgtctgtccaaaccatcgtttttccgtgtgtttcggcacaggagcggattaaccagccttcattggcgctgctatcgaaaaaattgacggttcggta

SEQ ID NO: 37830 - DNA, 35133 bp, Neisseria meningitidis
gtgctgtaaattatagtttggtgtgttaaacgcagttaacaatattttgctggattatactgaattcacagggtctttccaatcgctatcattgaaaatatgaaaaaatttgccaacggtatctgtataaaacaaataatcctttgaaaataattgtttatcctcaagaaaactctccttatgccgccatacgccgcctgccggcgcaagataacctttgccaatttgcagaatttacgttaaccttgcgttttccgcacccatagctcagttggaagagtgtcagtttccgaagctggaggtcacaggttcgatccctgttgggtgcgccaattataaagagaccgtctgaaagataaatatttttcagacggtcttttgacttacttcaaactcttatttcaagacttccgcaaatgcgcgggcaacatagtcggtattcgacgtattcagtccggcgacgcacatcctgccggaatccagcaggtaaacggcaaattcgtcgcgcagcctgcggacttgttccacgctcaatcctgtgtagccgaacatgccgcgctgtttgatgaaataagtgaaatcgcgattggggatttgcgcagttaagacatcataaagtttctgccgcatcgcacggatgcggtcgcgcatcatataaacctcgttttgccacaaggcgtaaagttcggggctgttcatcacgtcggcggcgatatacgcgccgtgcgcgggcgggctggagtagatgcggcggacggtgaatttgagctgtccgaacaccaaatccgcttcttccttattcgggcaaaccacgcttaagccgccgacgcgctcgccgtagagcgacaggttttttgagaaggaattgctgacgaacaagggcaattccatttccaccgctttgcggacggcgtaggcatcgctgtccaaatcgccgccgaatccttggtaggcaatgtccataaacggaatcagtttgcgcgttttgatgatgtgcaacacttcgtcccattgccgttccgacatatccacgccggtcgggttgtggcagcagggatggaggatcaggacgctgttttcgggcagggtgttgaaaaacgcggtcatttcgtcgaatttcacgccgacagtggcagggtcgtaatatgggtaagtgccgacctcgaaacctgcgccttcaaaaatgccgcgatggttgtcccaagtcgggtcgctgacgtaggcgcgcgcttcgggaaaccagcggtgcaggaagtccgccccgactttgagcgcgcccgagccgcccaaggtttgtacggtaacgatgcgcccttgcgcaagcgcgggattgtctttgccgaacaataaatgctgcaccgcgctgcggtaagtgtccaagccttccatcggcaggtagggcgacggcgcaggcgcggcggcacgggcggtttcggctcggctcacggattccaacacgggcattttgccttcgtcgtcgaaataaatgcctatgctcaaattgactttttcggggcgcgggtcgtttttgaaggtttcgaccaaactcaaaatcgggtcgccaggatagtattcgatgtgtcggtacatagtccttacctcttgctttttcaaaggattttctttttcaacaatacaccactttcgatatggtgcgtaaacgggaattggtcgaacagggcggcacgttcgaccgcatgggtttccgccaaggtgtccaaattggcgcgcaacgtttcgggattgcaggaaatgtagatgatgttgtcaaactgcgacaccagcttcaaagtttcctcatcgataccggcacgcggcggatcgacgaaaatagtggaaaatgcgtaatccgtcaaagcaataccgccatccttaaggcgtttaaactcacgttttccggtataggcttcggtaaattcttcagcagacagacgggcgattttgatgttgccgatgcggttggcttcgatattccattgcgccgcgctgacggaggttttggagatttcggttgccaaaacctgtcggaaatatcgggacagcggcagggtgaaattgccgtttccgcaatacagttcgagcaggtcgctgcccaagccttccgccgtgcggcacgcccattcaagcattttctgacacacggcggcattcggttgggtaaaactgccttcaatttgccgataacggaaatcccggttgccgaccttcaaagtttccgttacatagtcctgttttaagactattttctgtcccctgctccgcccaataacggaaatatccaactgttgctgtaacgcttgcgccgcctgcatccactcagcatcaagccttttgtggtaaatcatggtaaccagcatttccccgctgagcgtggacagaaattcgacggcataccagcgttttttgagttcgggggattgcgcggcggcggcgatcagctcgggcatgaggcggttgacagcctcggaagctgcttcaaaacggtcgcagcgtatcatgcttgcgccgctggctttctgccctttttcaaacatggcataaaacatttccccgccttcgtgccaaatacggaactcggcacgcatacggtaatgtttgtccggagattcgtacacttcccactcaggaacatccaaacctgcaaaaagggttttaaggtagtcttttttaccttgaagctgctgcgtgtagtcattcatatcgctatcctgaaaaatcagaccggattataagccgatttgcctcgccgcacgcaaactctttgactgccgccccttcaatgacggacgggcttttgtgctaaaatccgccatctttccacactataccgataaagggaaaaatcatggcaggcaacactttcggacaactcttcaccgttaccaccttcggcgaaagccacggcgcgggtttgggctgtatcatcgacggctgcccgcccggcttggaattaagcgaagcggatatccaatttgacctcgaccgacgcaaacccggcaccagccgccacgttacccaacgccgcgaagccgaccaagtcgaaatcctctccggcgtattcgaaggcaaaaccaccggcacgcccatcgccctcttaatccgcaataccgaccagcgcagcaaagactacggcaacatcgccaccagcttccgccccggccacgccgactatacctattggcacaaatacggcacgcgcgactaccgcggcggcggcaggagctccgcccgtgaaaccgccgcccgcgttgctgccggagccgttgccaaaaaatggttgaaagaaaaattcggcacggaaatcaccgcctacgttacccaagtcggcgaaaaagaaatccggtttgaaggctgcgaacacatttcccaaaatcctttttttgccgccaaccatagccaaattgccgagctggaaaactatatggacagcgtgcgcaaatccttggattccgtcggcgcgaagctgcatatcgaagcagccaatgtccctgtcggcttgggcgaacctgtttttgaccgcctcgatgccgaaatcgcctacgcgatgatgggcatcaacgccgtcaaaggcgtggaaatcggcgcaggttttgacagcgtaacgcaacgcggcagcgaacacggcgacgaactgaccccgcaaggcttcctgtccaaccactcaggcggcatcctcggcggcatcagcaccgggcaagacatccgcgtcaatatcgccatcaaacccaccagctccatcgccaccccgcgccgcagtatcgacatcaacggcaaccccatcgaactcgccacgcacggcaggcacgacccctgcgtcggactgcgctccgcgccgatcgccgaagccatgctcgcgttagtcctcatcgaccacgccctgcgccatcgcgcgcaaaatgccgacgttcaggttaatacgcccgacattaccctttcaaacaaataaaaatttagccaaaacacagactttataatagaatatcgagcattgccgtgcagccttgacgcacgggtttgtttagaggaatacaaccgaaatgacacaagaaaccgctttgggcgcggcactaaaatccgccgtccaaactatgagcaaaaagaaacagaccgaaatgatcgccgaccacatctacggcaaatacgatgtattcaaacgcttcaaaccgttggcgctcggcatcgatcaggatttgattgccgctttgccgcaatacgatgccgcactgattgcacgcgtcctcgccaaccactgccgccgtccgcgctatctgaaagccttggcgcgcggaggcaaacgtttcgatttgaacaaccgtttcaaaggcgaagttacccccgaagaacaggcgatcgcgcaaaaccatccttttgtgcagcaggctttgcaacagcagtccgcccaagctgccgccgaaacgctgtctgttgaagccgaagcagccgaatcttccgcagcagaataaatccccaaacgaaatgccgtctgaaaaccgatttggtttcagacggcattttttcgtatgcggcaatcacggttcaaatatccaattccgccgtatcgccttcgcgttccatccaagcgcggcgggcggcggcttcgcctttgcccatcagtttgacgaagatgtcgcgcgtctcgtcatctgcaccttctgggatttgtacctgcaacaggcggcgggtgtcggggtgcatggtagtatctttgagctggtcggggttcatctcgcccaagcctttgaaacggctgatggaataggcggtttctttaacgccttctttttgcagccgctccaaaatgctgtcgagttcgttttggtcgagggcgtagaatttgcgggcaggtttgctcttaccttgtgcgttgacatcgacgcggaacagtggcggctgggcgacgtagatgtgtccgtcggcaaccagtttcgggaagtggcggtagaacagggtcagcagcaaaacttgaatatgcgagccgtccacgtcggcatcggacaggatggcgattttgccgtagcgcaggccgcttaaatcgggatggtcgttaataccgtgcggatcgacgccgatggcgacggaaatgtcgtggatttcggcgttgccgaagagttggtcggggtggacttcaaagctgttgagcactttgccgcgcagggcaggatggcttgggtggctttgtcgcgggcgagtttggctgagccgccggcggaatcgcgttcgacgaggaagagttcgttttcgcggatgtcttcgctttcgcagtcggtcagcttaccgggcaggacggcgacgcgctgccttttttcttttcaatctttttaaccgaacgcatccgcgcctgtgcttggcggatggcgagttcggcgatttttttgccgaagtccacgttttggttcagccacaattccaaagggtcgcccgatacggtggcgacgagtttcagcgcgtcgcggttggtcagcttgtctttggtttgaccttggaactgcgggtcgaggacgcgggcagagagaacgaaggcggtttttccgaacacgtcgtcgctttgcactttaacgccgcgcggcaagaggttgtgcagattgatgaagttgttgactgcgttgaacacggcttgtttcaagcctgcttcgtgcgtgccgcccagcggggtggggatgaggttgacgtagctttcgttggcgcacgagccttcttccagccaagtcagggcaaacgccgctccttcgccgatgctgaaatcgccgttgtgttcgtctgaaatgtagttttcgcaagagaacagcggtacggcttcctgcgcgtcggcaatcaggtcggtcagatagcttttcaggccgtcggggtaatgccaggtttgggtgtgcgcttcgtcttcgcctttgaccggacgggtcagggaaacgcgcacacccggcagcagcacggctttggcacgcagcaggcgttcgagttcgggaatgctgtaattcgggctttcaaaatatttgccgtccggccagacgcgcacttctgtaccgctgtctttgacggcgcatttgcccacttgtgccaacggttcgaccacgtcgccgccggcaaacacgatgcggtggattttgccttcgcgtttgaccgttacttcaaggcgggtggaaagggcgttggtgacggatacgcccacgccgtgcaggccgcctgaaaaggcatacgcgctgcctccgtcttttttgttgaacttgccgcctgcgtgcagacgggtgaatacgagttcgactacggatacgccttcttcgggatgcaggccgacgggaatgccgcgcccattgtcgtgcacggaaagcgaaccgtcttcatgaatttgcacgtcgattgcagtcgcgaaaccgcccaacgcttcatccgacgcgttgtcgatgacttcttggcagatatgggtcgggctgtcggtgcgggtgtacataccgggacgttctttgaccggctccaagcctttgaggacggtgatgctggattcgctgtattggttgtttttagccatgggaataatctgaaagtaagaaaaacaacgctttcagacggcctgaaagcgttgcgttccgttgttttagcggttgtcggaagattggcgggcggcaaagtcttcataactttccataccgcgcaggaagcgggaagagagttctttcaacgcccccaaataaacgtcgcgtttgaaatcaatcacttcgtcaacgggtgcccaatattgatgccaacgccagccgtcaaattcggggtggcgggtggcgcgcaggttgacatcgcaatctcggccggtcaggcgcaggagataccaaatctgcttctgtccgcgataagagccgcgccattcgcggcgtacccagttgttcggcacgtcataacgcagccagtcgcgcgtgcggccgataattttgacgtgttgcggcaaaagcccgacttcttcgtacaactcgcggtacatggcggtttcggggctttcgcccggcttgatgccgccttgcggaaactgccaagaatgttcgcgcacgcgcttaccccaaaagacttcgttgcggttgttgattaagatgataccgacattggggcgatagccttccctgtccaacacggtgtcgccctccgttaaattcaatcttgggattttcccacaaatcaggcggttttgacaaatcagacggcatggcggtacgcgtgccgaaacacggggggatttgggaaaatatcttaaatttggtttacaataatgtatttcaaattattcgggaatcagaccatgttagatatccaattgctccgcagcaacaccgccgccgttgccgaacggcttgcacggcgcggttatgactttgataccgcacgttttgacacactggaagaacgacgcaagtccgttcaggtgaaaaccgaagaattacaggcctcgcgcaacagcatttccaaacaaatcggcgcactgaaaggtcagggcaaacacgaagaagcgcaggcggccatgaatcaggttgcccaaatcaaaaccgatttggaacaggctgccgccgatttggatgccgttcaaaaagaattggacgcatggttgttgagcatacctaacctgccgcacgaaagcgtacctgccggtaaagacgaaaccgaaaacgtcgaagtccgcaaagtcggcaccccgcgcgaatttgactttgaaatcaaagaccatgtcgatttgggcgaacctttgggtttggattttgaaggcggtgcaaaactctccggcgcacgatttaccgtgatgcgcggacaaatcgcccgtctgcaccgcgccttggcacagttcatgctggatacgcacacgctgcaacacggctacaccgagcattacacgccttatatcgttgacgatacgacgctgcaaggtacgggccaactaccaaaatttgcggaagatctgttccacgttacccgtggcggcgacgaaaccaaaaccacccaatacctgattccgacagccgaagttaccctgaccaataccgttgccgacagcattatcccgtccgaacaactgccgctgaagctgaccgcgcattcgccctgtttccgcagcgaggcgggttcgtacggcaaagacacgcgcggtctgattcgccagcaccagttcgacaaagtggaaatggttcaaatcgttcatcccgaaaaatcatacgaaacgctggaagaaatggtcggccatgccgaaaacatcctgaaggctttggaactgccctaccgcgtgattaccctgtgtaccggcgacatgggcttcggcgcggcaaaaacgtatgacttggaagtttgggtgccggcgcaaaatacctaccgcgaaatctcaagctgctccaactgcgaagatttccaagcccgccgcctgaaggcgcgtttcaaagacgaaaacggcaaaaaccgcttggtacatactttgaacggctccggcttggctgtcggcagaacgctggtcgccgtattggaaaaccatcaaaacgccgacggcagcatcaacatccctgccgcactgcaaccgtatatgggcggtgttgccaagttggaagtcaaataagtttgcaggctgcctgaacgtcaaatgccgtctgaaacctgtttcagacggcatttcctttaaacttttaaaacacgtcagccgtcggcacgaaccgcattgccgcaatcgccggtctgtccgacctcgcggatattggacagcgtaacttccgaaatattacccaacgcctcttccgtcaaaaatgcctgatggccggtaaacagcacattatgacaagacgacaggcggcggaacacgtcgtcggtaatcacatcgttggatttgtcttcaaaaaacagctcgcgctcgttctcgtacacatccatgcccaatgcgccgattttccggcgtttcaacgcctcaatcgcggcggcactgtcaatcagcccgccccggctggtgttgataatcatcacgccgtctttcattttgtcgaacgccgcttcgttcagcatatagtggttttccggcgtggcggggcaatgcagcgtgatgatgtccgaccgggcatacagctcgtctaaatccacatatttgccgccgattttttccgcttcggggttgcaaaacggatcgtaagccagcaggttcatgccgaaaccctttaaaatccgcatggttgcaataccgattttccccgtgccgataacgcccgccgttttgccgtacatattgaaaccggtcagaccttccagcgaaaaattcgcatcgcgggtacgctgataggctttgtggatacggcggttcaacgtcagcatcagaccgaccgtatgttccgcaaccgattcgggcgaataggcaggcacgcgcacgactttcaagcccaactcttcagccgcctttaaatccacattattgaagccggcacaacgcaacgccacagttttcacgccaatttgcgccaatttttccaacacgggccggctgccgtcgtcgtttacaaaaatacagaccgcttccgcgccttccgccattttcgccgttttcgcatccagcataaaatcaaaaaactccagctcgaagccgaaatgccggttggcgcgggtaaaatgttcgcggtcatagcttttcgtaccgtaaatcgcaatcttcatcaatatgtccagttgtcgtctatggttgagaaacggcataatacactgaattcaaacaaatcagtagaatatggtggattaaaattgattgcatgcacggcatttccatttcaaaacacaaaactcaatcgcccattgccgccagaagctcggcctgatgctcggcaatcagggcattggtgatttcttccaagtcgccgtccatcacaaaatccagcttgtgcagggtaaggttgatgcggtggtcggttacgcggccttggggatagttgtaggtgcggatgcgttcgctgcggtcgccgctgccgatgagggatttgcgctcggcggcttctttggcttgggcttcgcgtttttgcgcgtcgttcaggcgggcggcgaggactttcattgcctgcgctttgttggcatgttggctgcggccgtcttggcattcgaccaccatgccggtgggcaggtgggtgatgcggacggcggagtcggttttgttgatgtgctgaccgcccgcgccggatgcgcggaaggtgtcgatgcgcaggtcggctgggttcagttcgatgtcttccagttcgtccgcttcgggcatgacggcaacggtgcaggcggaggtgtggatgcggccttggctttcggtggcggggacgcgctgcacgcggtgtccgcccgattcaaatttcaaacggctgtacgccccgagtccgacaatacgggcgatgacttctttatagccgcccaattcgctttcgttggcggacacgatttcaacctgccaacggttgcgctcggcgtagcggctgtacatacgcagcaaatcgccggcaaacagcgcggcttcgtcgccgcccgttccggcgcgtatttcgatgaagatgtttttgtcgtcgtcggcatctttgggcagcagcagtttttgcagttcggtatcgagttcgccgattttggctttggccgcttcgatttcttcggcggcaaagtctttcatttcggggtcggacaacatttcttcggcatccgccaagtcgctttgggcaagccgatagttttggaacacttcgacgacgggggtcagttcggcgtgttcgcgcgtgagcttgcggtagttgtccatgtcggacgtggcttcgggctgtccgagaaggtgggtaacttcttccagtcggtcgctgagttgttgtagtttttctaagatagacggcttcataattcttccataacaaacgccgcctgaatgttcagacggcatcaacactggattattataataggttttccggatattcaaaaagataatcttagatggataacctaccgtcccaacagggcatcggcattgcgctccgttacctttgcaatctcttctacacaggttccgcggatttccgcagcaatctttgcaatacccggaatattggcaggcgtattaatctcttttttcagcataaacgggctatccgtttccaatacgaaatccccgtcgttcaaggctttaagcgtatcgcgcactttacgcgcgttcggattgagcagcagcgaaccgatgccgattttgaaacccagtttcgtcaacacacgcgcttcttccgcgctgccggagaaggcgtgaacgatgccgccttgggcaaagcctgtctgtttgacggcggcggcgatgtcggcggtggctttgagattatggataatcacgcggcggcgcagggtttgcgcaatttcaagctggcggacgaaaacttgaatttgccgttcgcgctgctgcgacgtttgggttttatcgtaaaaatccaagccgatttcgccgacccatgcctgcggataatgtgccaacatcgtttccaggcggacgaaatcccgctcggcaatgccgtctgaaaaccaaggatgaatgcccagtgcaatacggatttgaccgtgttcggacggcatttccgccaaatccgccacgtcctgccaatcctgcgggcgcgtcgcgggaacgataaaccgcttcaccccaactttccgcgctgcggtcaggatgtgcggcaggttttcgcgcagggcgggatcagcgagatggcagtgggtgtcggtgaagttcatttcgatttcacactaactttagtcttaccaattctttgtaaacatcttccttaccccagccttgcgatacggcgagggtcatcagcgcggtggcggtttcgaggttgcatttgccgccgttgatgatgcccgagttgcggaacgcgttgccttgcgcgtaaacggcggcggttttgccttgtcggacttggctgatgttgagcagcagtttgccctgccgcgcgaagtctcggacggcgcggataaaaccttcgtctgcgggcgtgttgccgtgtccgtagctttgcaggataagagcttgggcgggaagctgtccgagtccgtccgcaagttcttggacggcaaagccggggataagcgtgcggacagcgatttttgcctgcgggtcgggataacggattttgaggccgtctgaaacggctgctgcgtcttgggacgggaggcgaagattgtgccaaccccgggtttcgtcccattcggcaagcgtgccgaaatgcggattgtcgaagcctgcagcagtttcggtgctgactttgctgctgccgacggcgggatacagtttgccgtcaaacgcgatgacggtttgtttgagcttgaggctgaaggcggcaacggcggtggagaggttgcgcggggcatcgctgttttcggcggcgtaaggccattgggaaccagtcaggacaatcggtttgcccaaaccttgcagagcgagcgcgaggagattggcggtgtacgccatgctgtccgtgccgtgcagtatcaggatgccgtcgcatgaagggagtttgtcggcaatgatgtccagccaatcgcgccagtgttgcagcgtaacggaggaggaatcaatcaagggattgcagacgtgccactcgaaatcgaggccgtctgaaaagggggaaagggcttggctaaccagtgcggtatcggggcgcaggccttcgctgctttgggtcatgcctatggtgccgcctgtgtagaggacgaagattttttgtttcatggacatcatcgggtcgtctgaaaataataatacggcttatttaactatatttcggacagactggcaatttggcggcgcggacggttttcagacggccttcaaatgaaaaagcacccgagggctgtcgatatttgattttccaagtagatttttattcacgaaataggagagccgcaacaagcttaaatcccttgtgaggttcccaacacggaagataccgctttgtggattaaaaaatacggaaactattgaatatcgacaacctatttaggtgcttgattttattgtttgctttgcgcggcttttttggctgccttggcggctttgcgttgcgcccgcttttctttcaatttgctgcggtaaaactggatacgttggcgttttttccaccaaatccaagcgacaacggtcgcacctatacccaagataacaaaaatacccgattgcaggctgtgcattttcgccatcagccaatcgatgttgtgcgcaccgtattcgcccagataaatccaaatagggacggaaatcagtgcggccagtccatccataatgataaaacgcaagtatgaaaccttgcggctgataccggctgtaacaaatacggccgttctcaaaccgggcaggaaacgggcgacaaataagacccagttaccgtatttgtcgaatttttcctgaacctgctcataacgtttcggcgtcatgatgcgcgcaataggtttgaaccttaggattttctgcccccaaattcgtccggcggcgaacatgatgccgtccccgaccaatacgccgagcataccgactgcaaacataatatgcggattggtataacccatacccgaaatcacgccgcctgttaccaaggtcaaatcctcgggaatcggcacgccgaaaccgcagatgaccaatacaaaaaaaacagccgcataaccgtattcgacaaaaaaggcttctaaaaaagcaaacatggcggatattccattgtcggagataaaaagtcagaacaaaccgaaacattttctacatgaagcaggcattctatcaaagattatgccgtctgaaagcggaaaaaaggcagattcgcgcatcctccgcatgttcagacggcatttaaacagaaaaccggccggttctaaaaacggttttgcctgattttgcctaaatgccgccgatggcggcggcaatgcgttccgccccttcgcgcgcccaatccgcctgccgcgcctccaccatcacgcgcacgacgggttcggttcccgaagcgcgcaacacgacacgccctttgccttcgagttctttttccacttccgccaacacgtctttcgaagcttcctgccattgctgacctttttggatgcgcacgttaatcatcgtttgcggatacggctgccaatcggcgcaaacggtggcgaggtcttggttcagcgtttgcagtgccgccaaaacttgcagcgcggaaataatgccgtcgccggtgttgtgtttgtccatacacaaaatatggccgctggcttcgccgccgatgagccagccgcgttggttcagctgttccaacacatagcggtcgccgactttggcgcggcagaaatccacgccctgctctttcagggcgatttccatcgccatattggtcatgaccgtgccgaccacgccgccgatgttgataccttctcgggcgcgggctttggcaatgacgtaaatcaggctgtcgccgtcgtaaacctgcccgtttttatcgaccatcatcaggcggtcgccgtcgccgtctaaggcgatgccgtagtcggcttcatgctgtaaaacggcggcctggagtgtcttggtataagtcgcaccgcatttttcgttgatgttgtagccgttgggttcgttgccgatgctgacgacctgtgcgcccagttcgtgaaacaccttgggggcgacaccgtaccccgcgccgttggcggtatcgacaaccaacttcaaaccccgaaggtcggaatggctgggaaaggtggatttgcaaaattcgatatagcggtcgtccgcaccgctgatgcggcgtgcgcgaccgagacgggcggacggttgggttttcatttcgccgtcgattttggcttcgatttccaactcgacttcatcggaaagtttcacgccgccttcggcgaagaatttgatgccgttgtcggaataggcgttgtgcgacgcggaaatcatcacgccggcggacaggcgcaacgcgcgggtcagataagccacgccgggcgtgggcagcggtccggtctgtaccacattcacacccgccgccgtaaaaccggccaccaaagcggcttccagcatatagccggaaatgcgcgtgtctttgccgatgaggacggtcggtttctggtcggtgtcgtgctgcaccaaaacctgccccgccgcatagccgagtttcaatacgaaatcgggcgtaatcggaaattgccccacttcgccgcgcacgccgtccgtgccgaaatatttttttgccatgtgttgctccgagaatgtgaaccgttgtccgagattatacagtcagtttgtgccttgctgtctgcaccgttgatgccgtctgaaaccgccccgtccttttcagacggcatgaagtatgtgaaccgctgtttacagattgatgcccaacgcttcccacaccttcaacgcatccgctgtcgccttcacatcatgcacccgcacgatttgcgcgccgcgcgctacggaagccaacgctgccgccacgctgccgtgtacgcgttccgccgcatttgcctcgccggtcagctcgcctatcgtgcttttgcgcgatacgccgatgagcagcggaaaacctgtttccgccatcaattcgggcaaatgccgcatcagcgcgatattgtgttgcaagggtttgccgaagccggagccgaagccggggtcgagtatgatgcgttgcggtgcgatgcctgccgcgatacattccgctgagcgcgctttcaaataccgcgctacttcaccgacaacatcttgatatttcggattaatctgcatggttttgggcaaaccctgcatgtgcatcaggcaaatgcccgtgtccgcctgacgcgccagcaattcgaccgcgccctcgtcattcaacgccgccacatcattaataatatcgatgccgccgagtgccaacgctttttccataatcaccgtgcggcgcgtgtccaaactgatgggaacgccccaccccgccacttccgccaaaacaggctcaacccgcgcccattcttcttcaggcgaaacataatccgcacccgaccgcgtcgattcgccgccgatgtcgagaatgtctgcgccttcttttagaagctgttcggcatgtgccaaggctgtttgggcgttttgcgaatacacgccgccgtcggaaaaagaatcgggtgtgagattcacgatgcccatgattttcggtttgtccaaaccgatttcaaaccgtcctgcctgccaaacgtgtcgtgccatctgaactcctcccaaaataaaaaacagattatatgccgtctgaaaccgtcttgtgcgcttcagacggcaccgctattcgggcggcagacggcatgttgtccgaatgtctgctccgcctttgaatctgccggtatgcctgctatccgcccgacttttcaaaacaggttccgacgattccgcacgcgcctgccgcctttgccaagccgtacaggatttcctgcggcatatcgcggttccataatcccgtaatattcgcaatcacgggcagatggctgatttggcggactttcacgatggattcgacatccaaacggtagggatggcctttggtatggttcaatacgcccgactcgcccagaatcaggtggcggttgccgcgcgagacgacatattctgcggcattcaaccaatcttcggcagaatggtgcttgtctttacacagcaccaagggaatgttcaggtttccggcttcattcaatacggcaagatcggacatcagcccgccgcccaaatacaggatgtccgcccccgcattcaaagccgcttcgacatggcggacgttgcggacgcgcaccaatacgggtttccctgcatcatgcgccgatgcggtctgttccgccaaccgtctgcaccgtccccgcccttcatccgcacttgaagtgtcgtataagtttgccgaagtgaaaaacggatccagaaacactgcatccgcattgcgccatactgacggttctgcggcgatacggacggtttccccgccgccgaaagccacgcctttggcggcaacgcggctgtcttccgcccgattttcccgactgacggttttccatgtatccaaaatgcggacggctttctcgacctccggcagcgtctgcacctccctgacgctcaaaaccctatcgtcgccgattgcgccgatgacagtacgctcgtcgccgtgagaaatgtgttctcgcagacctctgctgcggataaaggcgacaacgccggcaatgtccgcttcggcggcacgcctgctcatgacaataatcatatttcctcctgacacaagaaacggcctacccaaaataggatttttgcaagccgtgttatactgtggcgtgttttacagattgttcgggctatggatttattatcggttttccacaaataccgtctgaaatatgcggtggccgtgctgacgatactgcttttggcggcagtcgggctgcacgcttccgtatatcgcaccttcacgcctgaaaacatccgcagccgcctacaacaaagcattgcacacacacaccggaaaatctcgtttgatgcggacattcagcgcaggctcctgccccggccgaccgtcatcctgaaaaacctgaccattaccgaacccggcggcgaccagactgccgtttccgtccaagaaaccaaaatcggattgagctggaaaaacctgtggtcggatcagatacagattgaaaaatgggtggtttcgagtgcggaacttgccctgacgcgcgacgggaaaggtgtttggaacatccaagacctgatcgacagccaaaaacgccaagcctcagtcaaccgcattatcgtcgaaaacagcaccgtccgcctcaatttcctgcaggaacagcttatcctgaaggaaatcaacctcaacctgcaatcccccgattcgtcggggcagccgtttgaaagttcgggcatactggtttggggaaagctgtccgtcccgtggaaaagcagggggctgttcctttcaaacggcatcggcccgcccgaaatctcaccgttccattttgaagcttccacttcgctggacggacacggcattaccatttccaccaccggcagcccttctgtccgcttcaacgccggcggagcggatgccgccggcctcggcctgcgtgcagacacttccttccgcaacctccacctgaccgcccaaatccccgcgctggcactcaggaacaacagcattaaaattgaaaccgtcaacggcgcatttaccgccggcggcgaatatgcccgatgggacggttcgttcaaactcgacaaagccaacctgcactccggcatcgccaacatcggcaacgccgaaatctccggcagcttcaaaacaccgcgccaccagaccaacttctccctcaattcgccgctcgtatggacggaaaacaaagggctggacgcgccgcgcctgtatgtatcgacccttcaggataccgtcaaccgcctgccgcaaccccgtttcatcagccggctcgacggttcgctgtccgtaccgaatctgcaaaattggaatgccgaattaaacggcacattcgaccgccaaaccgttgccgcgaaattcagatacacacatgaagacgcaccgcatctggaagccgccgtcgcactgcaaaaattgaacctgaccccctatcttgacgacgtgcggcaacaaaacggcaaaatatttcccgacaccctcgccaagctgtccggcgacatcgaggcgcacctgaaaatcggaaaagtccaacttcccggcctgcaactggacgatatggaaacctacctccacgccgacaaaggccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgacgcggtcatcgacctgaccgcgggcggcgaaacccgaaaagagcttatccgctcgcttcagggcagcctgtcgctaaatatttccaacggtgcatggcacggtatcgacatggacaatatcctgaaaaacggcatttcgggcaaaactgccgacaatgccgcacccagcacacccttccaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggcacggtggacaaaccgtccattaccgtcgattacggcaggctgaccggcggcatcaattcgcgcaaagagaaacagaaaatcctcgaagacaccctgctggaacaatggcagtggctcaaacctaaagaaccgtaaacatcctgcgtacaaaaatgccgtctgaaacacccccgcgcttcagacggcagaccgtaaaacctacaaccccaattcctcccaaatcccatcaatcttagccgtaaccgcagggtcttttttgatgacgcgtccccattcgcggtcggtttctcccggccatttgttggtcgcatccaaacccattttgccgccgagtccgctgacggggctggcgaagtcgagataatcgatgggcgtgttttctaccaaaacagtgtcgcgcacggggtccatgcgcgtggtgaccgcccagatgacttctttccagtcgcgcacgttcacatcgtcatccaccacgatgatgaatttggtatacataaactggcgcaggaacgaccagcagcccatcatcacgcgcttggcgtgtccggcgtactgttttttcatgctcaccaccgccatgcggtaggagcagccttcgggcggcaggtagaaatcggtgatttcggggaactgcttttgcaaaagcggtacgaacacttcgttcaacgccacgcccaaaacggcgggttcatcgggcggtttgcccgtgtaggtcgaatggtaaatcgggttttcgcgcatggtgatgcgttcgaccgtaaacacagggaaataatcctgctcgttgtaatagccggtgtggtcgccgtacgggccttccaacgcggtttcgttcggatggatgacgccttccaacacgatttctgcgcgggcaggcacttgcaaatcgttgccgatacatttcaccagctccgtccgcgaaccgcgcagcagtccggcaaactggtattcgctcaaggtatcgggaacaggcgttaccgcgcccaaaatggtggcggggtcgcagccgagtacgacggcgacgggatacggcgtatcgggattgagtttgcggaactcctgataatccaacgcgccgccgcgatgcgacagccaacgcataatcagcttgtttttgccgatgagttgttggcggtaaatgccgagattttggcgttttttgtgcggcccgcgcgtgacggtcaagccccacgttaccagcggcgcaacgtcttccggccagcaatgctgaatcggaagttgatacaaatcaacgtcttcgccttcccacacgatttcctgacacggcgcgtttttcaccacgttcggcgccatgctccaaatgtctttcagcagcggcagtttggaaaacgcatctttgatgcctttgggcggttcgggttctttcaaatacgccagcgtctgcccaatttcacgcagcttggacacgctgtccgcgcccatgcccatcgccacacgttcgggcgtgccgaacaggtttgccaacacgggataaccgtagcgcgtaccgtcgggcttaatcgggttttcaaacagcaacgccggcccttcggcacgcagcacgcggtcggcgatttcggtcatttccaaatacggggaaatggggtgtgcgacgcgcttgagtttgccctgctgctcgagcatggcgatgaagtcgcgcaggtctttgtatttcatattcatcctttttgtccttttatcctgaacaatccgattcggataccgcccctatccttgcctgtgcctcggcatattctatgccgtgataaaagtcgcgtaccagcggatgttcgccgccttgatggagttgcaacaaaggacgttgaccatcgggttgggtaacgacattgcagtgcagaccgaaggtgtcggtttcataagggggcagctggttgcagatcatgccgaaataaacagcgttttcaaggttgtcgtaaaagcggctttgatagtcgttaaaactcttttcgctgacggatacccacacgccatattccagcgtttcctcatgcccgataatcggaatcggcagcaccgcgcggataaagcggtcggtttggtcgggatagcggatgatgcagaaatcagaatcgcattctgcttgataagcaatgcgttcttcttcactgagttgattatagggatcgggtgcggtaaagccgattgcgggcatttcttcgtggttttcgccgcaggaagtgcaagtgtacataaggtttcagactttcaaaacgagtttgcggtaaagccattcgccggcaaacagcatccccatcaatacataggcaatcacgccggtataaaccgcccaccaatcatatcgccccaaccgtgccaacaaagcggcaagcgtcccgttgattataaaaaatacgcaccaaacctgcgttacccggcgggtatagcgcacggctttttcaggcaggtcgggctgttgcagccgcgcaagtttttcaatcaccgtctgcccggcaaacaggctgccgccgaacaccgccaacatcatcagattgacgaggacgggataccaatacatcgaatcatgccgcccgaacaccaatactgcggcaaaaaacagtgtaataaacaaagccgcataacgctgttggggcagtttggcagtcagggcgcgcagcagccacaacccgcacatcgccgccgccagccaaacaaaccagcccgcctccctgccgtatatagtggattaacaaaaaccagtacagcgttgcctcgccttgccgtactgtctgcggcttcgtcgccttgtcctgatttttgttaatccactataccacaaagcgggataggcaatgcttaatacggtcagaaaaatatgtccgaaaaaaccgggtttcattttgaatccgcacaaatgttttcagacggcatccgataaaaacatgccgtctgaaaaataattagaaatacccgattagcccgcctgaatcttcaataccgcctgtaccacgtcgttgacggtgcggacattgcggaaatcttcggcctgcagcttgcggccggtttcgcgcttgatgcggtcaatcaggtcgatggcatcgatgctgtcgatttccaaatcttcgtaaagattggtatcaggcgtaatccgttccggttcgatttcaaacaactcggtcagggtatcgcgcaacaaccggtagatttcttgttcggtcatatgtttcatccttatgcttggcggcttttgacaaaggcggcgagtgttttgacattggcaaaatgttcgcgcaagttctcctgctcgccgtccaatcggaaaccgaaatgtttttgcaccgccaagcccaattccagcgcatcgacggaatccagtcccagccctccgtcgccgaacagcgcgtcttcgctgccgatgtcggcggcggttatatcctccaaagccaaactgtcgataatcagttgtttgatttggttttccaagtcgttcatatggttttccttgtaaaatagtcctgcagatattcattcagccgccgcgccgcaatcggcaacggtttctcggcgagccagtcttgggggaggatgtcgtctccgacggtaatttcataccgtatccttttcggggggatgcggtaccacggctgcccctttttaaaattgggcggattcattttgatacatacgggcgtaatcacttcggcataccgcagtcccaaagaaaccgcgccccggtgcatttttacccgtccgtcccaccccgtcctcgttccttcggggaacaccagcaggctctgcccgctgtcaaaaaccgcctttaccgtttccagcattgcttccgactcttcgttcggaatatagcccgcacctttaatctggctgctcattgccggattgtgctgcaaatcttttttcacgatacagttcatttcgggcacatggccgacaagcagcaccacatccagcaaagacggatggtttgccaaaatcaactgtcccgggcggttgagtttttcaacacccttgaacgatacctccaacacgcccgaccatttcagataagcaacgaacaaacgccaagatgttccgataatccggcgcgccgccaattggcgggcgacagaccctgaagtgccgttcaaagtataaggcaacaaaaccaatttcatcataatgccgccgacaccgaaaatcacaaatcctaaccaagtcgcaaaaaaacggcggcaataatccaatttatccattccgctgccacagccattcacgattgcgatatacccggcggcattctcgactgccgttcagcagaaagcgcacccattccaaaccgctccaatatgcctcgggcagcataccggcttcagacggcatatcgtccgaagcagacaaagtcaggctgtaacgcgtccctttggtcagaaccatcgccaaagcataagcaaacggcgcgcgagtcgccgatacggcatatccttccggcagcggatcgtccgccgccaaaaccaaaaccgacccgcatccctcttccaacagtgatgccgcttccgccaatgccgtttccacaccgtcggcacacacggccaatgccgtctgctcgctcatatcctgacgcaatatcgaccattgccccgccgttgcattgtgcaccgacaaaccgaacgaagtcggcgacacggtatgcgatttcaacagttccaaccacaaatcgaaactgcgtgccatttccccgtcgtgcgaggcataaactaccggactgccgggatgggcggaggcaatgtcccaagccgcgtcgcataccaaacgcgccgccttactcaaacggcggcgctgcatagcgggcaggaacggcaattccggcctgacatcgggcaaaccgtcggcaaaatccggacattccgcccattttgcccactgggccatatcgcgcattttgctgcccgaaacccgccaggcggcgatgtcgaagtggaaccggcaaataatcgacggcatagtttctttcaaaaatttacactgtgccgcattctaaccaaagcctatccccctgacaatgccgaaattcaaacgcatttctgccccctttctccgacaacgccgcccctcggaaaaccgccagaattagcctgaatttacatttatcattataatgcccgtatttgccagcctgccgccgcaatatatggacacactgccagaatgcccgattaccaacaccgcctccctgctgccgcacagcgggcgtatggttctgatagaccgcattacccgatacggcgatgattttgtcgaagcaggggcacaggtaagccccaatcacatccttttacttgacgacaaactgccctacacggcatttatcgaactgatggcacaggctgtcggcgcgtatgccggtatccaagcccgaaaaaacgcacggtcggtccggctcggcttcctgctcggcacgcgcaaacttgaaatcttcgcccaatccgtcccaatcggcacgcatctgctggcaacggcgcatatgtctattcaggatgccgggggtatgggcgtgtttgactgcgaactgcgttggacagacgcgccggaaacttcgtccgaaacactcccttcagacggcattttggcgcgcgcctcactcaacgtgtacagccccgaacaccctgccggaacaaccgatgccgtctgaacaggcacacacatacggagaacaacgatgaccgaaactgtcctgattaccggctccaacaggggcataggcaaagccgtcgcattcggtttggcggaagacggctttgatatcgctgtccactgccgcagtcgccgcgacgaagccgaagccgtggcggaagaaatccgcgctttgggcagaaatgcgcgcgtgttgcagtttgacgtgtccgaccgcgaagcctgccgcgagattctgaccgccgacatcgaagcaaacggcgcgtattacggcgtggtgttgaacgccggactgacgcgcgacaataccttccccgcgttttcagatgacgattgggatgtggtgctgcggactaatttggacggtttttacaatgtattgcatccgctggttatgccgatgatacgccgccgcaaagccggacggattgtgtgtatggcatcagtgtccggcctgacgggcaaccgcgggcaggtcaattacagcgcgtcaaaagcaggcattatcggcgcggcaaaagccttggcggtcgaactggcgaaacgcaaaatcaccgtcaactgtgtcgcgccgggtctcatcgataccgatattatcgatgagaacgtacctgtcgaagaaatcttaaaggctgtccccgcagcgcttatggggctgccggaagaagtggcgcacgcggtgcgtttcctgatggatgaaaaagcggcgtacatcacgcgccaggtgattgcggtgaacggaggtttgtgttgaataccagaagggtcgcagtaacaggcataggcggcattaccgccttcggccgggattggcaaagcatacaggcagcattcaaagccgaaaaaaacgccgtcaaatatatggattggcacgaacgtttccccgaattggaagcgcaactgggtgcgccgattgaaaattacgcgccgccgaaacattggacgcgcaagcagctcagaagtatggggcgcgtgtcgtacctgtgcgtcgatgcggcggagcaggcgctggcggatgccggtttgctcggggacgaaagcattaccgacggacggatgggcgttgcctgcggctcttccagcggcagcaccaaagacatcggcgatgtgggcgaattgttgctgaccggcacgtcgcgcaacttcagcgccaacacctatgtgcgtatgatgccgcacaccaccgccgccaatatcggcatctttttcgggctgaaagggcgcatcatcccgacatcgagcgcgtgttcgtccggcagccaaggcataggttatgcctacgaagccatcaaatacggtctgaccgatatgatgctggcgggcggaggcgaagaatttttcccgtccgaagtgtatgttttcgactcgctttatgccgccagccgccgcaacggcgaaccggaaaaaaccccgcgcccatacgacgcgaaccgcgacgggctggtcatcggcgaaggcgcggggattttcgtgctggaagaattggaacacgccaaacggcgcggtgcgataatttacgccgaactcgtcggctacggagccaacagcgatgcctaccatatttccacgccccgccccgacgcgcaaggcgcaatccttgcctttcagacggcattgcaacacgcaaaccttgcacccgaagacatcggctggattaatctgcacggcaccgggacgcaccacaacgacaatatggaaagccgcgccgttgcagcggttttcggcaacaatacgccctgcacgtccaccaagccgcaaaccggacacacgctgggcgcggcggacgcaatcgaagccgcgttcgcgtggggcattgccgaccggcaaagcaatcccgaaggaaaacttccgccccggctttgggacgggcagaacgaccccaacctgcccgccatcaacctgaccggcagcggcagccgctgggaaaccgaaaaacgcattaccgccagctcgtcgtttgccttcggaggaagcaactgcgtcttaatcatcggatgaaataagtttgtcaatcccaccgctatgctatacaatacgcgcctactcttgacgggtctgtagctcaggggttagagcaggggactcataatcccttggtcgtgggttcgaaccccaccggacccaccaattcccaagcccggacgtatgtttgggcttttttgccgccctgtgaaaccaaaatgctttgagaaaccttgataatgaaaaaagtcagcgtattgattgttgccaaaaacgaagcaaaccacattcaggaatgtattgaaagttgccgtttcgataaagaagttatcgttatcgacgactacagcaccgacaatactgccgaaattgccgagggtttgggcgcaaaagtcttcagacggcatttgaatggggatttcggagcgcaaaaaacatttgccatcgaacaggcaggcggagaatgggttttcctgattgatgcagacgaacgctgcacgccggaactatctgatgaaatctcaaaaattgtccaaaccggcgattatgccgcctattttgtcgaacgccgcaaccttttccccaaccatcccgccacacacggcgcgatgcgtcccgacagcgtatgccgtctgatgccgaaaaaagacagttcggtgcaaggcaaagtacacgaaaccgtacaaaccccctaccccaaacgccgtctgaagcattttatgtaccattacacgtacgacaactgggaacaatatttcaacaagttcaacaaatatacttccatttcagccgaaaaataccgagagcagggaaagcccgtgcgtttcgttagggacattatcctccgcccgatttgggggtttttcaaaatttatatcctgaacaaagggtttcttgatggaaaaatgggttggattatgtccgtcaaccacagctattacacgatgattaaatatgtcaaactatattatctgtacaaatccggcggaaaattttaaatggaaaaagaattcaggatattaaatatcgtatcggccaagatttggggtggaggcgaacaatatgtctatgatgtttcaaaagcattggggcttcggggctgcacaatgtttaccgccgtcaataaaaataatgaattgatgcacaggcgattttccgaagtttcttccgttttcacaacgcgccttcacacgctcaacgggctgttttcgctctacgcacttacccgctttatccggaaaaaccgcatttcccacctgatgatacacaccggcaaaattgccgccttatccatacttttgaaaaaactgaccggggtgcgcctgatatttgtcaaacataatgtcgtcgccaacaaaaccgatttttaccaccgcctgatacagaaaaacacagaccgctttatttgcgtttcccgtctggtttacgatgtgcaaaccgccgacaatccctttaaagaaaaataccggattgttcataacggtatcgataccggccgtttccctccctctcaagaaaaacccgacagccgtttttttaccgtcgcctacgccggcaggatcagtccagaaaaaggattggaaaacctgattgaagcctgtgtgatactgcatcggaaatatcctcaaatcaggctcaaattggcaggggacggacatccggattatatgtgccgcctgaagcgggacgtatctgcttcaggagcagaaccatttgtttcttttgaagggtttaccgaaaaacttgcttcgttttaccgccaaagcgatgtcgtggttttgcccagcctcgtcccggaggcattcggtttgtcattatgcgaggcgatgtactgccgaacggcggtgatttccaatactttgggggcgcaaaaggaaattgtcgaacatcatcaatcggggattctgctggacaggctgacacctgaatctttggcggacgaaatcgaacgcctcgtcttgaaccctgaaacgaaaaacgcactggcaacggcagctcatcaatgcgtcgccgcccgttttaccatcaaccataccgccgacaaattattggatgcaatataaactgctttcagacggcatatgccgtctgaaagcctttgatgcaacaaaccactaaattatattcgttcattggaaagaaacaccccgaattcatccttcaaaataagaaaatcccaatatcccccgatattacgcagcctattggcaaagttttgcagcgtcttccccggcttgtgctgccgcgtcaagtgctttgttacaatgtatagtagactaacaaaaaccagtacagcgttgcctcgccttagctcaaagagaacgattctctaaggtgctcaagcaccaagtgaatcggttccgtactatctgtactgtctgcggcttcgtcgccttgtcctgatttttgttaatccactatactaccttcacatttcttaataaattttatgagtaaccatacttcttggtcgtccaaaatcggtttcgtccttgctgcggcaggttcggccatcggtttgggcgcgatttggaaatttccttatacggcaggcaccaacggcggcgcggtgtttttcctgctgtttttgatatttactatcttggtcgccctacccgttcagcttgccgaattttatatcgggcgcacgggcggtaaaaatgccgtcgattccttcagggttctgcgtccgggcacgcaatggctttgggtcgggcgtatgggcgttgccgcctgctttattttgctgtcgttttacagcgtggtcggcggatgggtattaaattatgtcgtccacagttttacgggggcggttcataccggcgcggactttgaagccttgttcggcgcgacgatttccaatccggcaggttcgctgtcctatcaggcactgtttatgctgattacggtttgggtggtcaaaggcggcatttcagacggcattgaaaaggcaaaccgttatctgatgccggggctgtttatcctctttattgcgctggcaatccgttcgctgacgctgccgggtgcaatggagggcgtgtctttcctgctcaaaccgaattggtcgtactttaaagccgatacgatgattacggctttaggccaggcgttttttgccctgagcatcggcgtttccgccatgattacctacgcttcatatttgggaaaagatcaggatatgttccgttccggccatacgattatgtggatgaacctcttggtttcgctgcttgccggcctggtgatttttccggcggtgttcgccttcggttttgaaccgagccaggggccgggattgatttttatcgtattgcccgcagtgtttatgaagatgccgttcggtacggttttgtttgcggtatttatgctgctggtcgttttcgccacgctgacttcggcattttcgatgttggaaacggtcattgcctcaaccatccgccaagacgagcgcaaacgcaaaaaacacacttggcttatcggcacggccattttcattatcggcatcccgtccgcgctgtctttcggcgtatggggcgagtttaaggttttcggcaaaaccatttttgatttgtgggactatgttatttccgccgtcattatgccgattggtgctttgagtgtttccatctttaccgcctggattcaggacaagcagtctgtgttaaaagatgccggcgcgggcagcaccgtaccacgggcagtgctgctgctgtggctgaataccttgcgctaccttgccccgattgccattattattgttttcatcaattctttggacatcctttaaaagccatccaaacagcaaaaatgccgtctgaaagcctttcagacggcatttttgcttcgggttcagcctatttcgttcaaagtatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatagccttgcgcgatgccgttcaaggacaaacccatacccttttcggcaaaacggatttcacggtcgtcaaacgagactttgccgaagccgacccgtttcagggcttcgtccacgctgttttgaggaggcggcgtttccgcatcgggacgggcggcaaaataatcggcatacagtttccacaacgcctgcactgtcggatcgaacgcgccgtccgtcagcgcgtgaatatcgcggcacaggctcaacagttccaaaaaatccgccgacggcgaagtcagataaccgtccctgttcaggcggctgatcaggctgtcttcacggtaaaggctgaacaattttttccaaacgcgccacttccgccaaaaccttgttgaccaaatccgccgcacgcctgtcgtccacaccgaacagacggagctccgcaccggaacccagtgcgacacctttccagaaaaacacattttcattgcgtttttcatccccgttgcgtttttcatcatcggcggcaaaaggattcggcaggaaagaaaccgccgcgcccgccgccgcaacggcggcaaccgtcagaaaacgcctgcgcccgaaatgcctgcccataccgcctctaaaccgacactgccgccttgatatgcggatgagggtcgtaaccttccaactcgaaatcttcaaacttgaaggaaaacaaatctttgacttcaggattgattttcatcactggcaaggcgcgcggttcgcgttccaactgcaatgcggcctgctcgaaatggttgcggtacaaatgcgcgtcgccaaacgtatggacaaactcgcccgcctccaatccgcacacttgcgccatcatcatggtcaacaatgcgtagctggcaatattaaacggcacaccaaggaaaatatctgcactacgctggtaaagctggcaggacagtttgccgtcggcaacgtaaaactgaaacagcgcgtggcagggcggcaaggccatttcatcgaccaaagccggattccacgccgatacaatcaggcggcgcgagtcgggattcttcttgatttgttccagcacattggcgatttggtcgatatgcctgccgtcgggcgcgggccagttacgccactggtagccgtaaaccgggcctaagtcgccgttttcgtccgcccactcgtcccaaatggaaacattgttgtcctttaggtatttgatattggtatcgcctttgagaaaccaaagcagctcgtggataatcgaacgcagatgcagctttttggtcgtcagcagcggaaaacctttgcccaagtcaaaacgcatctgataaccgaatacggagcgcgtacccgtaccggtgcggtctgatttgtccgtaccgttgtcgaggacgtggcgcatcaagtccaaataggctttcatagcagtctttcatcaaattaaacggcgcatattgtaacatttccggataatgcccaaaacacggatacaggcaggcaggattgttggcaatttcagtccttttccacagtaaaacccggtgggaaaacaaaattaccttgattggaatcaaaaaatctagtttaattacttagaataaaatttcaataatatttttatttacgaaattaatttatgattattgattaattatcggcaacaaacatcaaacatcgaaaatatggaaaaaataatgtcaacaatttttgccaaatcgggcttggcatcagaaaaaagtaggtttatattcccacctacaaaactgttttcccattagtacactatcaaccaaaaggagtatccgaatgactgacctgaacaccctgtttgccaacctcaaacaacgcaatcccaatcaggagccgttccatcaggcggttgaagaagtcttcatgagtctcgatccgtttttggcaaaaaatccgaaatacacccagcaaagcctgctggaacgcatcgtcgaacccgaacgcgtcgtgatgttccgcgtaacctggcaggacgataaagggcaagtccaagtcaaccggggctaccgcgtgcaaatgagttccgccatcggtccttacaaaggcggcctgcgcttccatccgaccgtcgatttgggcgtattgaaattcctcgcttttgaacaagtgttcaaaaacgccttgaccaccctgcctatgggcggcggcaaaggcggttccgacttcgaccccaaaggcaaatccgatgccgaagtaatgcgcttctgccaagcctttatgaccgaactctaccgccacatcggcgcggacaccgatgttccggccggcgacatcggcgtaggcgggcgcgaaatcggctacctgttcggacaatacaaaaaaatccgcaacgagttttcttccgtcctgaccggcaaaggtttggaatggggcggcagcctcatccgtcccgaagcgaccggctacggctgcgtctatttcgcccaagcgatgctgcaaacccgcaacgatagttttgaaggcaaacgcgtcctgatttccggctccggcaatgtggcgcaatacgccgccgaaaaagccatccaactgggtgcgaaagtactgaccgtttccgactccaacggcttcgtcctcttccccgacagcggtatgaccgaagcgcaactcgccgccttgatcgaattgaaagaagtccgccgcgaacgcgttgccacctacgccaaagagcaaggtctgcaatactttgaaaaacaaaaaccgtggggcgtcgccgccgaaatcgccctgccctgcgcgacccagaacgaattggacgaagaagccgccaaaaccctgttggcaaacggctgctacgtcgttgccgaaggtgcgaatatgccgtcgactttgggcgcggtcgagcaatttatcaaagccggcatcctctacgccccgggaaaagcctccaatgccggcggcgtggcaacttcaggtttggaaatgagccaaaacgccatccgcctgtcttggactcgtgaagaagtcgaccaacgcctgttcggcatcatgcaaagcatccacgaatcctgtctgaaatacggcaaagtcggcgacacagtaaactacgtcaatggtgcgaacattgccggtttcgtcaaagttgccgatgcgatgctggcgcaaggcttctaagcaaacgccgccgctccgcaaacaaaatgccgtccgaaccgcaaatgctgttcagacggcatttccttatccgcccgttcaaatcgggtgagactaccgatacatctgaatatgctatgccgtctgaacggcattcacaccgcccaatcctgcacgcgcttcaaatcattttgcgccaaagtatctgcgtggcggttacggctctgatattccctgtctttcaagatgctgctcgccacataattcaaatgtgcctttgccgcctccgaagcctcgcccggccggcggtttgatattgcctcatacaatacacggtgctgcgccatcagcttcggacgcggatcttcttcctgattcagataaataaggctgctgcgcgtctgccggtacagcattttcaacaaaccgcccgacaaatggctgaacaacaaattgtgcgccgcatcggcaatcgtctgatgaaagctgacatcagcttcgctctgatgttccaaattgccgctttcgcacgcctcctcaaacttttcaagccaaaacccaatccgcttcaaatcggcatccgtgcggcgttctgccgccaatgccgccatacagccctcgatgtggcaactgaaatcaaaaacatcctgttcccaattggaatgcttgcccaaaagctcctgccaactttgcaaaaaatcctgctgcggcttgaccgaaacataataaccgtctccctgcctcgcttccaaaacctgacgggcgaccaaaacattcaatgccgacctgaccgacgggcgcgaaacgccgaactcttccgccaaaacgcgttcgggcggaatcttgcccccttccgcgtaaaccccttccgcaatgcgctcctccaataccgacaatacctgatcgctgattttctgaggccttaccagtttcatcactcctcctttataaagattccctgcagaacccttccgaaatatagtggattaacaaaaatcaggacaaggtgacgaagccgcagacagtacaaatagtacagaaccgattcacttggtgcttcagcaccttagagaatcgttctctttgagctaaggcgaggcaacgcc

SEQ ID NO: 37831 - DNA, 16678 bp, Neisseria meningitidis
gggtttatgaagcggcttgccggcaaacagatcataagcaaacataccgcctactttatgccctcctctgaagccgaccactgcacccatcagctgcttgcccgatacatattgtgcactttcgccagatacgcggccatagtccgcaccgagatagaactgatggttcggatgaaaataccaagttaaagtattctgccagtagaaacctcgctctccgaaaagactctgctccccatcaaatccgcgaacggtgtagcggctgccgattgacaatttatcttgggcaaccaacggcgttttgttccattgagcttgaatggcggttgcgtagaaaaactgctgtttgcctaaaataaatggggcggctgcgtccaaactggcagtaatgattttcatacgagatgtacctggaagaatatcgccgccgttttcttccggtgcaggcatactttggcgcatgccggtcccgcgtttgtaagacaacttgccgtcaagctgccaacggttgaggtaagcacggtggcgcaattcggcttcccagcctgcagagcggcggcgttgtacttcgatttcggcatcgtcgatgtatttataggtttggcgtgtccataatttcattccgactgaagttttatgaagtctgttacgccaaagcatgcgctcggcggccaggctgctctgatattgtttgccgttgtaatcgtaattgacggaatagccttcggttgcttcgtggtaacgatgtccattgtgattaaaagaaaacagccatttttttacgggcaccgaataatgcacgctgtaacttctggatccgctttcagtttccgtaccggtggcatcagtcaagtccgttttgtgcgccaaaccgcgtccatatgaaacataaaacaaatcgcttaagcccaaagggttatcgaacgataaagcgacatttccttgatatttgccggtcgttttgccgcccgcatcatctataccgatactgaaccgtatgggtttattctgctgccatttgatctgtaaatcgcttttgccttcttcttcggacggtataatctgaatatctgttttaacactcggcaaacgacgcaggttttccaagccctgctctacatcgcgaagattgagaattttgttcctatataagggaaatttgttattgaatgcactaatactgccctcggcagacttcccatcccgtttttcttcatagcggatatcccctatttcgcctgctgatacccgtaatttcagaattcccgaatccatattctgtggttggataatagcttgggaagtgaggtagccacgcacgatcagtatctgttgcgcggctttttgtagcctgctcaaattattggaacctaaacacatcccagttttaaaagctgtttctttcatgagcacagaaggaagaaaagaaaatttgcgcaccgtcttatcatctaaactaatgtaatttacccgagtacacggtgtttcatcttcactcaggacataattgttcttctccaatggttgctcgaaacggacatttgcatcagttaacaattcagcatctatgtgctgctgacgctgcatggaacggataagttctgcatcgttttcatcggcagctaaggttttaaggggtatgacagccaggataaccaacagacatggagcaggaaaaaatttcatgacatcaatattattttagcaatatttactattttgtcataaatttaaaagtatttacagttatagaatgagacctttgcaaaattccccaaaattcccaccaagacatttaggggattttggggaattttgcaaaggtctcggacagtattttgaacgcagtgcgcgtaaattcgtatggaaaccatgaaatcccgccacagccgccagacatgccaagccgcattctgatatttctgtttgcaggataacaggcagctttttctttaagcccaaagacaggttttgcagatggggcatagatttcctttttgaaaaatagggattaggaagttggatgtattttagaaaggccgcctgaaaaggtttcagacgaccttttgcgactagctgctattttatttaaagcttttctctaacaaacgagctaatatttttcctgtaataaaacagataaaaaacagcatccaatacgtcagattggaaaaatcggtcgtatagagaatcaacatataaagaagcagcatgatgccgagtgcgatgaattgataatgtttggcaaacatcatgacctcctcaactattaaggcaaaccgcctgaatattctcgttcaatcgtttcggcaatttccctataacgtcgataccatgaccagtcgaaattttcaatggcatggctcgcaaacgtaccaaattcaggcatccctatgcggctacctgctaaagctccgattgtagctccccaaccaggcggattactgaacgtattgtttggcaatcctaaagatttatcaggatttcccgtatcgttaagccctgcagattcgcaaatttcgcaataatatgagctttgttgcgcattacctgagcctccgacccaagtcatttcatgaacacatatagtggattaaatttaaatcaggacaaggcgacgaagccgcagacagtacaaatggtacggcaaggcgaggcaacgctgtactggtttaaatttaatccactataaaactctcattttgaaactccttgtatcgttaatcaaacaatcaaaagggcagatgccctatccttgcttttacaaacggagtgcctgtaaaaggggatggtttcaggcagttttgaagtttgtgtttttatatattgtcttctggtcgtctgaaaaggtttcagacaacttctttatctttacagcctcaagtcttacagtttgcccgacatactataaatcagctccaatacccattcgtacaatcaccgtttctcgtgtaggatgtctgcttccaacgtcatgccgatttgcagcggtttttcctcaccgtatgcagtgatggttgatttgtcgggttttattttcacaagataaacaggttcgttgctcttcgccaaatcggaggataccatgcccaatcccgacaattcctgtctgcccagtgccgtttttgctactgatacgacactgccggaagcaagcccgaatttttgatagggatatgcctgataacgtaggacaaccttgtctttcggcttgataaagcctgctgcactgctggggatatatagatgggcatatagctcggtacgttcgggaacaatgctcaagagcagtttggaaggatcaacctgctgtccgacttcgacgttcggtattgctatataacccgaccgtcctgcacggatgatttgttcagagcgcatttcaaaatccaaaacttcttgagaaatatcggcaatggtgcgttcaagccagctttgttctgtctcatgccgcttgggggaggctggccaatgtcagattctgcgtgcggatttcctgaagcagcccgacttcttctcggcggtaggcatcaagtttggctttctgctctaaaagctctgccttgacattcatcatttcttgttttggcactgcatcattggcggataggaaacgatatttctgcaacatttcttccgcaagtctaatgcgccttttctgaccgtctatctgttgcgaaatatggagttcctggttttccaaacgttcgacagttgctttaaggctgcgcgtttcattcccgtgtatcagcttcagacgacccagttcctgttctgccaacgttttcttcaaaactgcctccgttttcaactgctgctgcacgctacctcctgcgccgaaacgtgaggtcgaaagcgcaaatagcttgtcgccagccttaaccttttctccatcttccacgaatttcgctgtaattgtccccgtatccggtgcatacaccctgattacgcccgatgcaggtaaaatttgtccctccactgttgtctttcgcgtatagttaccaaatatcaaaaacaggataatcaataacgcagatatcgatgcaaatgtcgtccatagggaaaatgacaacggtcgtgtcagaatcactttacccgtcaggctggtttggcgggcaacggcgacttcgggacggaagaagggttgcttgggtctattcataaaattgaagttaagaaagtttcagacgacccctagagattgtctggacgatgagaaatatcagcagtaatctgtaccgtcagtgtagccgtttcctgatttatctgcttttgttgcgggagcagttaatccatgttcaatctcaaagattggtcttccgttataaggaggtgcattaacggcatcatttacccaattacgagtcacattgtatacaccatttgcaccagcagcaccgtaagcatttttcggcagataataaactgccgctgcggcagcaggtattgcaaccaaatccccccatgtgggacctcctttggttgtggcagcattagctacatttccagctatattgtctgttacaggacctccccctgaaaccagcttcaattcatgaagttgaagttcaatcatttttatactccttttcttggttggtattcctaaaaattcggctaacaaaaacatatggcagatatattgaaaaaaaattcaaagtaccctgaataaaattcaaattccaactatatttgttaatgtagtcgagaagaaacatatctgataaaaaatatagcacttgataacaagctattactaatattacgaaaaatgtaaattgcttccagtttttcatagaatccctcacaaaatttccagaaaatctaactctatcaactgataaatcaacttcctaacttcttcatattttccctgattgaagttaaccagtagatttttcaacaataacggttcattcttaccgatgtgttctaacacttttttccccaactcatctacgcttatcttcatcccattcccaatcaaatatcccttttccaacgtatccaaattattggcatttaatctcaacctgacgtcgtctgaaagcggagtagcgttgggattcgcgaactgttcgagatgaaaagcggtatcggtacgttctttgccgagaaagtcttcactgaaggcttcataattgacggggtcggcaatcatggcagcaatttgtgcggcagtatcgttgatacgcgtcctatcttgctcccagtctgagaaactgtggcgcagactttctatggtgggaaatttcttcattagccactcgaggtaattatagccgttgggtggaaaggtaccgacagcgaagtggaaggtttcacagccgagcgggataggtctgtgccaccaaccgcgtgggatgtagaggacatcacctgcttcaaggataatatccatatcgatatgttcaggaatggaaatatcagtatctttagtctgttgcatatacaatggcatagggaaatcaggggcagtaagttgccaacgtttcttgccgaaaagctggatggcatacacatcgcgggggtcccaatggtttttataagattcgtcgctgccaaaagcaagatatccactaacaatagtatgtgcgccggcaaagcgggcgacttgacgggcgatatggtctgaaaacggctcgttgttaatatggttatagactaacgacgcaccattcttcatatgttcgtagataacggatttaataaaacggtagcgagttttgcccaaatcgtcgaaactttcgacgtattcttctttaggaacgattgcgccttttttacgcagatgaaacagcggtgcggttgggtctgctcgttggtatatctcgttgatatctttccaagatgcggattcgagattccgaaccgctcctttaaagagcttgggcttttgatacagataagtctgtcggaacgttttaggactaatgccgaagtcgagatggatgctcattacttccccttactcagaaaatatttaaaatttataatgttacatatatttacaaatattaaagtttttttttgtgtgtgcgtcaaggaattgttgacaattttagttaaaaatttgtctccaaacggaaaaaagcggtttgttttttgttgttaacatttttattgtaattaaataaaaggtcgtctgaaaacggttttcagacgaccttttgctataatcgggcttcatcgccccgttcggtttggaaccttatgaaaaccctcgtcctcctcctgctttccttctccacgaccaccgctttcgccgcatacggtttgggtttggggcaggcaccgaaatatcctgccggctttcgcgcctacggttatgtttattccggacggcagggctaggttttaaaaacagaggcggatgccattaaattagacacgcttttcaaacgctttgtgtaccgtccttccgccgccaatcaaaaccccgtcggacagcgttcggacggcatacccgccaaccacacaaaggaaaaaccatgagtaaaaaaatcaaagtcggcattgtcggcgcgacgggctacaccggcgtggaactgctgcgcctgcttgccgcccatcccgatgtcgaagtcgccgccgtaaccagccgcagcgaagcgggaaccgcagttgccgattactttccgagtttgcgcggcgtgtacggcctcgccttccaaacgcccgacgaggcaggtttggaacaatgcgacatcgtcttcttcgccacgcccaacggcatcgccatgaaagacgcgccgcgcctgattgaacagggcgtgcgcgtcatcgacctttccgccgacttccgcatacgggacattccgacctgggaacactggtacggcatgacccacgccgcccccgacctcgtttcccaagccgtgtacggattgagcgaactcaaccgcgaagccgtcgcacaggcgcgcctcgtcgccaaccccggctgctacccgacctgcgtatccctaccgctcgtgccgctgttgcggcaatgccgtctgaagcccggtatgccgctgattgccgactgcaaatccggtgtgtccggcgcgggcaggaaaggcaatgtcggttcgctgttgtgcgaagccggcgacaacttcaaagcctacggcatagccggacaccgccacctgcccgaaatcaggcagaccatcgccgggcttcaggacggcatcgccgaaggattcgtgttcacgccgcacctcgcgccaatgatacgcggtatgcacgccaccgtttacctccacctttcagacggcagcgaccccgaaaccgtcctgcgcgactactaccgcgacagcccgttcgtggacatcctgccgaccggttccgcccccgaaacccgcagcgtgcgcggcgcaaacctctgccgcatcagcatccaacaggcggcgcaatccgatgtgtgggtcgtcctttccgtcatcgacaacctcgtcaaaggcgcggcgggtcaggcagtccaaaatatgaacattatgttcggactggaggaaacacacggcttggacgcaatccccctgctcccctgaagcgcaaacagcaaaccgcaggcatcgtgcctgcggtttttgatgccgtctgaaagcgacgtttttttgggttcggacggcttttgacccatccattcacacgaaaacaaaaatctaaaataccgtcattcccgcaaaagcgggaatctagtttatccagcttcagcaatttccgacacatttccacacgcttcgattccgtcatttctccggtttcagtcattgccgataacaccgtggtttttcatttctagattcccgcctgcgcgggaatgacggcggagggcttgccgtttttcccggtaaatacctgcaatttaaaatcccatcattgccgtgaaaacaaaccaaaaacctaaaatcccatcattgccgcgaaaacaaaccaaaaacctaaaatcccgtcattcccgcaaaagcgggaatctagtttatccggcttcagcgatttccgacacatttccgtacgcttcaatttcgtcatttctccggtttcagtcattgccgataacaccgtggtttttcatttctagattcccgcctgcgcgggaatgacggcggagggcttgccgtttttcccggtaaatacctgcaatttaaaatcccatcattgccgtgaaaacaaaccaaaaacctaaaatcccgtcattcccgcaaaagcgggaatctagtttatccggcttcagcgatttccgacacatttccgcacgcttcaatttcgtcatttctccggtttcagtcattgccgataacaccgtggttttttatttctagattcccgcctgcgcgggaatgacggcggagggcttgccgtttttcctggtaagtctctgcggcttctcattgccggtttccgcctacttgggaatgacgtgatttaaaatcatgaaaatgtgtcaaaaataatatagtggattaacaaaaaccagtacggcgttgcctcgccttgtcgtactatctgtactgtctgcggcttcgtcgccttgtcctgatttttgttaatccactataaaaatcagatttccgttacacttttttccaatatttcagacggcattttgctcacacgcccaaatacccttccctgccggaaagccaccttgccaaatgcgcttcgacgatttcggggttttgttcaatcagcatcggggcggtttcgcgcgcttgttccaagaggtgcaggtcttcttcgagcttggcgaaacgcagcataggcacgccgctttggcgcgcgccgagaaattcgccggggccgcggatgttgaggtcttggcgggcgatttcaaagccgtcggtgtgttcgtagatgactttcagccgcgctttggcgagttcgcccaagggttcggcaaacaggaggacgcacacgctttctgccgcgccgcgcccgacccgaccgcgtaattggtgcagctgcgccaagcccatgcgctcggcgtgttcgatgaccatcagggcggcattgggcacatctacgccgacttcgatgacggtggtggcgaccaagacgttcagcccccccgaagaaaaccgcgccatcacttcggccttttcggcggccttcatgcgcccgtgtaccagtccgatattgagttcgggcaatgccgtctgaagccgggcgagggtttcggcggcggtttgcagttgcagggtttcgctttcttcaatcaatgggcagacccaatacgcctgccgcccttttcggcaagtgccgaggacgaagccttcgacttcggcgcggcggacgttgttgacgaggcgcgttttaatcggtgtgcgcccgggcggcaattcgtcgatgacggacacgtccaaatcggcgaaaaaactcatcgcaagcgtgcgcgggatgggcgtggcggacatcatcagctgatggacttcgcgccctttgtttttgagggcgaggcgttgggcaacgccgaaacggtgctgttcgtccacaatggtcaagcccaaattgtgaaacgccacgccgtctgaaaacagggcgtgcgtgccgacggcgattttgacgctgccgtcggcgagtttggctttggcttcgtctttggcttttttacgcaaactgccaaaaaggcggacaacttcaatgcccaaaggttcgagccattgtttaaatttaataaaatgttgttcggcaaggatttcagtgggcgccattacagccacctgcgcaccggattcgatagccgtcaaagcagacaaagcagccacaatggttttgccgctgccgacatcgccctgcagcaggcggtgcatcgggtaggtttgcgccatatcgcggcagatttcggaaacaactttttcttgcgcatcggtcagggcaaacggcagggcttggcgcagggcttgggtcaatgtgccgtcgccgcccaatgccgccgccgtgccgccgatacgcttctgtcgcgccaagcgcatcgaaagctgttgcgccaaaagttcatcgaatttgagccgttgccatgcaggcagcgtgccgtctgaaagctgatgaatcgtgaaactcggcggcggcgaatgcaaaagacgcaggctttcggcgaggtgtggcagcttcagacggcacagcagggcatcgggcagcgtgtcgtgcagcggcgtaacgtccaacgccgtctgaataatacggcgcaaagtgggctggttcaaaccgtttacggtcgggtaaaccggcgtgaggctttccgccaaaccgccgccctcggcatcgcggattttgggatgaatcatctcgtcgccgtaaaagccgtgtttgatttcgcccacggcgcggatgcgtttgccgaccgccgtctgtttctgatggctggcgtaaaagtggatgaagcgcagaaaaaggacgctgccggagccgtcggcgatttggacaatcagctgcttgcgcggtttgaacgttacttcctgatggataacctccccctcgacctgacacggcacgccaatcggcgcgtccttaatcggcataatgtgcgtctcgtcctcgtaacgcagcggcaggtgcaacaccaaatcccacgcggtatggaggttgagtttgtcgagcttcttggcggaaacatcggtgattttgagctgttttcgggtttcgggcgacatcataggcagattcctttggacgcgcctattttatccgaaaacaaaaatgccgtctgaaacggattcagacggcatcgacaggcaggaatcaagccccggcggcttcggcttcctgctgttgttggtaaatcgcctcaaaattaatcggcgcgagcaggacgggcgggaagccggcgcgcgttaccgtaccggaaacggcttcgcgcgcgtaagggaagaggatgttcggacacgccacgccgagcagcaggtcggcatcttcttcggggatgttttccaaacggaaaataccgctttgggttacttcgttcaaaaacatcgtgcgctcgttatccaatttggcggttacggtaacggttacatccacgttgtagtagccgtcttccagcttttggctgccggtggaaacgcgcatctccacttcgggctcgccctgttccaaaaagatttgcggcgcgtgcggcacttccaaagacaagtctttgacatacagtcgctcgatgctgaatacgggttgcagttcttcgctcattttgttttcctagttgggggttaagggttcagcagtccgtccagcccgccttcctgctggaggcggtagaggtcggtaaatccgccgacgtgcgtttcgccgatgaaaatctgcggcacgctgcgctgtcccgaaagctgctgcatttcggcaaaggcttcggggcttgcatcgacacggatttcgtcgatatgtccgacacctgccgcgtgcagcagccttttcgccatcgcgcagtaggggcaaaacggacctgtgtacatggtaacggtctgcatattgggtttccgaaagttttgcaatgataatcaatataggggcatttcccctgtttggcaagtgcggaacagatgcacgttcaaacggcatgtgcggaatgtgtcaaagtttcttttttaaagtatgatagacattgtgaaaaatatttttgcacccgcgctgcgcggcggaacggatgcaaaatatttttattacattttcaggaaaaaccatgttgtcaggactccccatccccaaagacatcgcgcgcccgcccgaaacgatattggtcaacatcacgccgcagaaacgcgcgtagcggtgttggaggaaaacaatatctgcgagctgcacatcgagcgcaacagcgaacacagcctagtcggcaatatctatttgggcgtggtgcgccgcgtgctgcctgggatgcagagcgcgtttatcgacatcggcttggaacgcgcggcgtttttacacatcgtcgatgtcctcgaacaacgccgcaaccccgaagaaacccagcgcatcgaacatatgctgtttgaagggcagtctgttttggtgcaggtcatcaaagacccgatcaacaccaaaggcgcgcggctttccacccaaatctcgctggcggggcgtttcctcgtccatcttccgcaagaagaccacatcggcgtgtcccaacgcatcgaagacgatgccgaacgcagcagcctgcgcgaacgcctcgacaagctcctgccggaaaatgcctgccggggctacatcatccgcaccaacgccgaaaacgccaccgacgaacagctccagtccgacatcgactacctgaccaaagtgtgggaacacatccaagaacaggcgaaaatccggccgcccgaaaccctgctttatcaggatttgcctttaagcctgcgcgtgttgcgcgatatggtcggctgcgacacgcaaaaaatcctcgtcgattccaccgtaaaccacgggcgcatgacgcgttttgccgaacaatacgtccacggcgcattgggcaggatagagctgttcaaaggcgaacgcccgctgtttgaaacccacaacgtcgaacaggaaatcagccgcgccctgcaaccgcgcgtcaacctcaacttcggcagctacctgattatcgaatccaccgaagccatgaccacgatagacgtgaacaccggcggcttcgtcggcgcacgcaacttcgacgaaaccatcttccgcaccaacctcgaagcctgccacaccatcgcccgcgaattgaggctacgcaacctcggcggcatcatcatcatcgacttcatcgatatggcacaggaaagccaccgcgaagccgtgttgcaggagcttgccaaagccctcgccttcgaccgtacccgcgttaccctgcacggttttaccagcctagggctggtcgagctgacgcgcaaacgctcgcgcgaaaacttaaaccaagtcctctgcgaaccctgcccttcctgccaaggcagaggccgtctgaaaacgccgcaaaccgtatgctacgaaatccagcgcgaaatcgtccgcgaagcgcgccgttacgatgccgaaagtttccgcatcctcgccgcccccaacgtcatcgatttgtttttggacgaagaatcgcaatccttggcaatgctgatagatttcatcggcaaaccgatttctctggcggtcgaaaccgcttacacgcaggaacaatacgacatcgttttgatgtaaaaaatgccgtctgaagccttcagacggcatctgtctatttcagggtttccttgtccaacaacgcgcgtatcagcagaccgcgtccgaaacgtcggctgtcggacaattccaaatatccgccgtattttttggcaagcgtgtcggcgatggacagacccagccccgtcccctgctgctccgttcccaaaatacggtaaaacggatcgaggacacgggcgcgttcggattcgggaatgcctttcccgttatcttccacccacacggcaagatatttcccttcgtccgtgaaacccaaatctatcctgccttcgggcggcgtataacgtaccgcgttgtcggcaaaggttttaatcagcgtatagatttccgtttcgtcggcagacacttcgacatcgcctccgaccgccacgccgatgtcctgacatttttccaaagccagcggcatcagttcctgcaacacttggcggaaacggctttgcagaccgaatgtcgttttcgtcagagggatttcatccgactgcgaacgcgccaatgccaaaagctgttcgagcaggtgtttgttacgccgtatgctttgctgcaaaacggcaggctgccgcgccgcatcgggtgggagcggcatattgttgagccgttccgcctgaaggggaagggcggtcatcggcgtacgcaattcgtgtgccgcgtcggcgacaaaccgctgacggtggcggatgtcttcatccgcacgtttcaaaagcaggttgatggcggttacgaaacctctgatttcactgggaatattgtccacactcaaagcagacaggtcattgattcggcgttgttcgagactttgcgacaatttgcggacggggcgcatggctttgtgcgtaatccacacggtcagcaaaatcatcagcggcagtgccgccaacaggggcaacacgctttgccgtgccgcatccgccgccaaatcttcacggtattcgttttcctgcataacggcaatccgtccctgctcggtcgtgcggatatagacgcggtaataatcgtcgtcatcgtccgcctgaagcgtgtgcagaccgtccgccagatgcgcaggcaggctgacaacagggtcttcctgctgcggcatctgtaccaaaatacgcgtatcgccgtcgccctcgggcaaagtttcgggtttggaatcgggggcgacgtacaatgccgcctgacggagcaggtcgtcctgcaacgcttccgtttcgtggaaggtttcgtagtaggaaaacatacctgcaagcattgccagcggaacaaacatccaaaccgtcccgccccggcaaacccaaatccagcagcatcaagtcataaggctgggcagcggcagccgcgcgccgtttttgacccaatccaccgcatagccgccgtctttcaaacttgccgacaccgcctccgcaatcatcgcatcgtcttccaccagcaaaacacgcatcaactttcccttcaaaataaaccgtgcctattctaacaccccaaaattagccgcaatttagcggtctttacgcttgccggtatttttcaaaactgcagcacaaaaaaaccgcgccggcaactgccttcagacggcattggggcgcgattgcaacacacgggcaggcaggcagagcctgcgacagaccacaggaacgattcaggcttcagacggcttcgccgtttacggcagaggcacgattcctgccgctatcgaactggccaatatcgccagcgacaaaccccacgcccagaaaaacgaataacggatgtgtttgcccatcgacaatttcgccaaacccaagcccatccacaaagccggcgaaagcggcgtaacaaaagtgccgacgatactgccgatcaacatcgcataacctgctgcttcgggcgccacgcccgcctgcgaggtaatctgctccacaatcggaaacagtccgaaataataagcgtccgtactcaaaaccaactcaagcggaatgcccaacacaccgatggcaatatgcagataaggcagcagcgcgtccggcaggatatgcacaatgtctttggaaatcgcgtccaacatccccgcacccttcaaaatccccaaaaacgtacctgccgccaaaataatggacgccatcatcaccgcgccgccggcgtgggcataaatccgctccatctgttcctgcgggctgcggtaattcaaaagcaacgccgccgttgcagccagcataaatacataacccggtgggaagatgcccgaaaaaagcaggctcatcgccgccaaaaacagcaggacattccaccaaaacagtttcggacgcgccaatttttgttcttcttccgacaaaggcaccggctttatcaaatccgccacggcgggcaacgcgcccaactcccggacaatccgccttttttcacgcacacccaaaagcagggacagcgcaaggataaacaccacaccgataatttgcaccgtcaacaaaggtttatacaattcgcccacatctgcgcccaacacgcttgcaacccgcccggtcggcccgccccacggcagaaggttaatcaatcccgcactggaagtcagcagcaaaaacagcaggtaaggattcatatgcagacgcttgtaaagcggcaaaagggcggggacgaccaataaaaacgtcgtcgcacccgccccgtccaactgcgccaccaccgacaccaagaccgtccccacactcactgccacgatattaccccgagtcagcttaatcaaaccgcctatcatcggacggaacagccccacatcgttcatgattccaaaaaacaaaatggaaaacataaacataatcacaatctgcatcaccgatttggtgccgcccgaataaaattcttttaattgggatacatcaaaccccgccagcaacgccccaaacagcggcaccaagattaatgcgatgatgggcgacactttttccgtcagcagcagccatacgatgaccccgataatcagcagtccgataaacgtcagcatcatttctcctttattttattttaaacagaaaaccgaccgtgcaggcaaaaccgcccacagacgcgggataagccctgcattctacttttttattttgaaacaagtcaatcggtcatttcctcccatttacgcctgccgccattcctgcatccgtccgtcatttcacagcggcaaccgatacggaacaaccggtaaatcggtatcgggacggcgcgggggcattcatcccggtgcgccgattcaaacgaaaccgcccctatcattgcggagcgcggggcgtgccgtacacgcgggattttatagtggatgaacaaaaatcaggacaaggcggcgagccgcagacagtacaaatagtacggaaccgattcacttggtgcttcagcaccttagagaatcgttctctttgagctaaggcgaggcaacgccgtactggtttttgttaaaccgctataaacacgccggtcatttgccgcgcattatccggcaaaagggaaaccttgaggctgcccagcccaaataaaaaaagccgcaaaa

SEQ ID NO: 37832 - DNA, 30078 bp, Neisseria meningitidis
taaccggattgaaatgtcccctgcccattttgctggcgaaaaaggctttggcgcaaatgcagcagggcgacgtgttgaccgttctggcaaccgacggcggmgcaccgggggattttgaggctttttgccgccaaaccggtcatgtgctgttggatgcttccgaacaggacggcgtgttcacgctggtcgtccaacacaaataaatgccgtctgaaatgcggatgtcccgcccgacggcgttgtttttgaatatcgtatgtgccgcgtgccgtttcaaaaacaaaccgtccggcgtgcagtgtcggcatttcgggcgtatcgccgccgatttgttccggaatggctgttaaccgccttgccgtcggcaaagaagcaaaacccaagcacaatcaaaatctaaaggctgtgtttgaagattccgttgatgcaacccaatcagtcggacaaaatgcctttcatccaatggaaccggtttccgaccggacggaataaccggctttcccccggcaaacggatggaatcgaccgggtattcaaacgcagccaaaacctaaaaaggaacaaccatgcaaaccctgaccattatccgccccgacgatatgcacctgcacctgcgcgacggcgacgcgctcaaagccgttgccccttataccgcccgccaaatggggcgcgccgtcattatgcccaacctcaaaccgcctgtcgtcagtgtagccgacgcgcttgcctacaaagcgcgcattatggcggcgttgcccgaaggtagcgcgtttgagccgttgatgacgctttatttgactgataacgccacgcccgaacttgtacgcgaagccaaagccgccggcatcgtcgccttcaaactctaccctgccggcgcgaccaccaattccgattccggcgtaaccgacctgttcaagctcatccccgtgttggaagaaatggcgaaacagggcattttgttcctcgttcacggcgaagtaaccgaccccgaaatcgacatcttcgaccgcgaagccgcctttatcgggcgcgtgatgaaacccgttttggcgcaagtgccgaatcttaaagtcgtgttcgaacacatcaccaccgccgaagccgcccgcctggttttggaagcaggcgacaacgtagccgccaccgttaccccgcaacacctcctgctcaaccgcaacgacctcttggtcggcggcgtgcgcccccatcatttctgcctgcccgtactcaaacgcgaaacccaccgtcaggcattggtcgccgccgttaccggcgagaaggcgcataaattcttcctcggcaccgactccgcgccgcacgccaaatccgccaaagaaaacgcctgcggctgcgccggtatgttcagtgcgatgaccgctatcgagctttacgccgaagtatttgaaaaagcaggcgcgttggacaaactcgaagccttcgcctcaaaaaacggcgcaaggttctacggcattcctgaaaataccgacacgatcaccctcgtcaaacaaagccaaaccgttcccgcaagtgttccctacggcgacggcgaacttgtcccgatgcgcgcgggcggcgaaatcggctggacggtgcagtattgatgggctggaaacaaaatgccgtctgaagggagggctttcagacggcatttgtgttgctgactgattgatacgtcaacggcgtttgagtttgttacgtttcggttatttccgataaattcccacaattttcaaatttcgccattcccacgaaggcaggaatccagaaattcgatgcgaccagagtttatcaaaaacggcagcaactcaaaaaaccggattcccgcctgcgcgggaatgacgagattgaagtttcagaatttatttgaaatacccaaaattcaaaaaaccaaattcccacctgcgtgggaatgacgaaacaaagaaagcagaaataaggacatagaactttctttaaatttgtgatgcatcaacggcgtttgggctcgtcggggcggatttgggcggcgagtttgtcgaggatgccgttgacgaatttgtgcccgtccgtgccgccgaaggttttggtaacttcgatggcttcgttgataatgacggggtagggcgtttcgggcatggcggacagctcgtggcaggcggtcagcaaaacggcgcgttcgatggggttgaggtctttttcgtccctgtcaagtagcgggcggatttgtcggatatactctgccgcattggtttgcgtgccgaagaaaagtttgttgaacaattcttcgtctgccttggcaaagtcggacatttcgcggatgtttttagcaatttcgggcgcggcggtgcggttgataagggattggtaaacggcttgtacggcaagctcgcgggaacggcggcgggctgttttcatgatttttccttgaaacggttgggcggcacggtatgccgtctgaaacggaaagggtgtattggtgtacgccctgtttgttattcttcgtcttcaaactgttcttcgagcagcaggttgacgaggttggcgcattcgacggcgactttggcggcatccgaggctttttcttcaatccgttcgattgcctgcgcgtcgttttcggtggttaggacggcattggcaatcgggatattgtagtcgagtgcgacgcggctgacgcctgctccggattcgttggaaaccagctcgaaatggtaggtttcgccacggatgacgacgccgatggcaatcagtgcgtcaaacttttcggaagaggcaaagttcatcagcgcgatggggatttcaagcgcgccgggtacggtggcgacggtaatgttttcgtctgccacgcccaattcttggagggtgcggcagcagactttgagcatttcgctgccgatttcgttggtgaagcgtgcctgtacgatgccgatgcggaggtgtttgccgtcgaggttgggggcgatggtgttcattgggtgtcctttggtattcggaggtttcggaatgccgtctgaaggtttcagtcttgcggctgccagtcggcgacggtttggaatgtgccgtcttcggcaagctcccatgcgctgccttcgggttgggagagcagtgcggcggtttcagggttggttttggcgatgtcggcgaggctgacgatgctgaagttgtccggatcgtcggtgtattcgtcggtctcgtcgccgctgaagaaacgccagccgctgtcgttttcaaaaacgggggcttcgcggtagaggaagccgacgggccggttttgtttggcgacggtgttggtggcgatacagcggtcgagtgccgaggaaagtgcttgtgcaaatgcgttcattacgggaatacgttgggggaaaacttacggattttaccacgattcgtgcgttgtcggcagacggcggcggtttggtggtacaatgtgcgccgtttgcagccttaaggtgtttctgtatttttggagtatggaaacgcattcgggctgttttttgcggaagacggtaatgaaagacgatgttttgaaacagcaggcacacgcggcgatacagaagaaactgggctacgcgttccgcgatatttcgcttttgcggcaggctttgacgcacaggagccatcatgcgaagcacaacgagcggttcgagtttgtcggtgattcgattttgaattatacggtggcgcggatgctgtttgacgcgtttccgaagttgaccgagggcgagttgtcgcggttgcgggcaagtctggtcaatgagggcgtgctggcggaaatggcggcggaaatgaatgtcggcgacggcctgtacttgggggcgggcgagttgaagagcggcggcttcagacggccttcgatactggcagacgcgatggaggcgatgtttgctgccgtcagcttcgatgccgatttcaacacggcggaaaaggtggtgcgccatttgtttgccgatcgcgtccggcgcgccgattttcaaaatcaggcaaaagacggcaaaactgctttgcaggaggcgttgcaggcgcgccgtttcgccttgccgaaataccgtatcgaagagcaaatcggttatgccaacgacagtatgtttgtcatttcctgcgatttgggcgaactgggtttcgtgtgccgtgccaaagggacgagccgcaaggcggcggagcaggaagcggcgaaagaggctttgaaatggctggaagagaagctgccgctgaagaggaaaaagaaatgaggcggcgcgtgaatatgccgtctgaacatatggatacgaaagcaaatatggatattgaaaccttccttgcaggggaacgcgccgccggcggataccgttgcggcttcgtagcgattgtcggccgtccgaacgtgggcaaatcaacgctgatgaaccatctcatcggtcagaaaatcagtattaccagcaaaaaggcgcagacgacgcgcaaccgcgtaacggggatttataccgacgataccgcgcagttcgtgtttgtcgatacgcccggctttcaaaccgaccaccgcaacgcgctcaacgacaggctgaatcaaaatgttaccgaggcgctcggcggcgtggatgtggtggttttcgtcgtggaggcgatgcgctttaccgatgccgaccgcgtcgtgttgaaacaactgcccaagcacacgccggtcattttagtggtcaacaaaatcgacaaggacaaggcgaaagaccgttacgcgctggaggcgtttgttgcccaagtgcgcgccgaatttgaatttgcggcggcggaggcggtcagcgcgaaacacggattgcggattgccaacctgttggagctgattaagccgtatctgcccgaaagcgtgccgatgtatcccgaagatatggttacggacaaatcggcgcgttttttggcgatggaaatcgtgcgtgaaaaattgttccgctatttgggcgaggaattgccttatgcgatgaacgtcgaagtggagcagtttgaagaggaagacggtttgaaccgcatctatatcgccgttttggtcgataaggaaagccaaaaggcaattttaatcggtaaaggcggagaacgtttgaagaaaatttccaccgaagcgcggttggatatggaaaaactgtttgataccaaagtatttttgaaggtctgggtcaaagtcaaatccggttgggcggacgacatccgcttcctgcgcgagctgggtttgtagtttttcttgctgaactttacgcaaatgccgtccgaacaggtttcagacggcattttgtttcaatcgggaatatctttgttaaaaacgggttgatattatctgtgcatattatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcaatccactataaagaccgtcgggcatctgcagccgtcattcccgcgcaggcgggaatctagtccgttcggtttcggtttttttggctagtgccgcaacattaaatttctagattcccactttcgtgggaatgacgcgattagagtttcaaaatttattctaaatagctgaaactcaacgcattggattcccgcctgcgcgggaatgacgaatttcaggttgctgtttttggttttctgctttttccaataaatgcccccaacctaaaatccgtcattcccgcgtaggcgggaatctagacattcaatgctaaggcaatttatcggaaatgactgaaactcaaaaaactggattcccactttcgtgggaatgacgaagtggaagttacccgaaacttaaaacaagcgaaaccgaacgaaccggattcccactttcgtgggaatgacgggatgcaggtttccgtatggatggattcgtcattcccgcgcaggcgggaatctaggtctgtcagtgcggaaacttatcaggtaaaacggtttcttgagattttgcgtcctggattcccactttcgtgggaatgacgcgattagagtttcaaaatttattctaaatagctgaaactcaacgcactggattcccgcctgcgcgggaatgacgaatttcaggtttctgctttttccaataaatgcccccaacctaaaatccgtcattcccgcgtaggcgggaatctagacattcaatgctaaggcaatttatcggaaatgactgaaactcaaaaaactggattcccactttcgtgggaatgacgaagtggaagttacccgaaacttaaaacaagcgaaaccgaacgaaccggattcccactttcgtgggaatgacgggatgcaggtttccgtatggatggattcgtcattcccgcgcaggcgggaatctaggtctgtcagtgcggaaacttatcaggtaaaacggtttcttgagattttgcgtcctggattcccactttcgtgggaatgacgcgattagagtttcaaaatttattctaaatagctgaaattcaatgaaccggattcccgcctgcgcgggaatgacgaagtggaagttacccgaaacttaaaacaagcgaaaccgaacgagccggattcccgcttgcgcgggaatgacgggattaagttttcaaaattcatcagaaattactgatttaatagcataaattttttagattatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataagtcattccggcggcaatttttgttgctttaacgggataggcggttggcggttgcgataaaggcggcgactttggcggcatcttttttgcctttagacgcttccacaccgccggatacatcgaccgattccgctccggtgatgcggacggcttcgccgacgttttcaggggtcagcccgccggcaagcacccacggtttgcccgaatattccgccagcagcgtccagtcgaagcggtttccggtgccgccgtattccgaaggatggtaggcatcgaacagcagtgcctgagcgtcggggaagcgcgtggcggcgtttcggatgtctgatgccgtctgaacacgaatggctttgatataggggcggtggaactggcggcagaatgcgtcgtcttcgtcgccgtggaattggatgatgtgtatcggcacttcggcaaggatgcggcggatgttttgcgcgctttcgttgacgaaaagggcgacaacgctgacaaacggcggcagtgcggcggtgatttttttggcgcgggcaatatcgacggcccggctgctgccttggaaaaagaccagcccgacggcatccgcacctgccgctgcggcggcagctgcgtcttccggtgtggtgatgccgcagattttggtgcggattttcctcattcggtattcctttatttgggaaacggcgcgcttttgccgtttcagacggcattcccgatcagtcgattttgatgtattcgacagaaaggatttcaatttcctcacgcccttccggcgtgttcaaaaccacttcgtcgccttcgcgcgctttaatcagacaacgagccagcggcgaaatccaagaaattttgttttgcgcggtatcgatttcatcgatgccgacgattttgacggtttgctcgcgcccgtcgtcgcgcaacagtccgaccgtcgcgccgaaaaacacttggtcggtcgcttcgcgcaattcgggatcgacgacgacggcagcctccaaacgtttggtcaggaaacggatgcggcggtcgatttcgcgcatacggcgtttgccgtaaagatagtcgccgttttcgctgcggtcgccgttgcctgccgcccagttgacgatttggacgatttcggggcgttctttgttgaccagttgataaagctcgtctttcaatgcctgccatccggcgggcgtaatgtagtttttggtttcggtactcatattgtgtgcggatgaaacgggaaatgtgatgccgatatgggaaatgccgtctgaaaacccggcgttcggatttcagacggcatcgcggtttgggaagccttattcttcgtcgcccgcatcgctgatgctgatgctgtgttccatcctgctcgggtggattttcagaccgccgcagccggatttctcggcagacaggcggtcgaggtaggcatcatcgatgtcgccggtctgataaatgccgttgaaacaggacgaatcgaaggattcgattttcggattgagtgctttgacgacggcttccaaatcgcccaagtcttgaaatacgatgccgtccgcgccgatttcggcggcgatttccgccgcgctgcgcccgttggcaatcaactcttcgcgcgtgggcatatcaatgccgtacacattgggatagcgcacttcgggcgcggcggaggcgatatagactttgcgcgcgcccgccgcgcgtaccatttcgacgatttcgcggctggtcgtcccgcgcacgatggagtcgtccaccagcaacacgcttttgcctgcaaattcggtttccatcgggctgagtttttggcgcacggattttttgcgcgtcgcctgtccgggcataataaaggtgcggccgatatagcggtttttaatcaaaccctcgcggtagggtttgtcgagatggacggcaagctccatcgcgctggggcggctggtgtcgggaatgggcatcacgacatcgatgccgtccacgggcagctcgcgtttgattttttccgccagcgacacgcccatatccaagcgcgattggtaaacggatacgccgtcaatcacagagtcggggcgggcaaaataaacatattcaaaaaggcaggggctgagtttggcacggtcgctgcattggcgggcaatcattgtgccgtcaaagccgacaaataccgcttcgcccggccggatgtcgcgttccaaatcgtaggtaagcgcgttgaaggcgacggattcggaggcgacggcataggattttctgccttcgctgtcggtttgcgaacccaataccagcgggcggatgccgtaagggtcgcggaaggcgagcataccgtagcccgcaatcatggcaatcacaccgtatgcgccgcgcaccaggcggtggacttgggcaacggcgttgaaaatattgtcggcattgagccggtgcgggtcggcgtttttagagacttcgcggcgtaattcgtgcgcgaatacgttgagcaagacttcggaatcggagctggtgttgacgtggcgcaggtgtttgttacacacgttttcatacagttcggcagtgttggtgaggttgccgttgtgcgccaaaacgatgccgaacggcgagctgacgtagaaaggctgcgcctccgcgctgctgcctgcgttgcccgcagtaggataacggacgtgggcgatgccggcgttgccggtcaaatcgcgcatattgcgtgtgcggaacacttcgcgcaccatgcctttgcctttgtgcatatggaaggtaccgccttccgccgttgcaatgcccgccgcatcctgccccctgtgctgcaacatctgcaagccgtcgtacagaagctggttcacgggttcatgactgaccaaacctaatacgccgcacatatcgtcttctccgattcgaggtttaagggtaaaacggaattataaagtaaacggtggttttttgcctgaattgttgacaatatttgagcgaaggacagataggtgggtttatggagaataagatttatagtggattaaatttaaatcaggacaaggcgacgaagccgcagacagtacaaatagtacggcaaggcgaggcaacgccgtactggtttaaatttaatccactataatctgtgatatggctgaggaaaggaaaaaacatttcagacggcataaaagaggatgccgtctgaaatatccgtatggcaatcaatcgtcttccggagtttccgccgtgccgccgctatggttcaacacggcttcggaaagcgatacgaaaaacggcagtgtgtaagattgccgccattcttcggtatcgggcaggtcggtttttgaagcaagcatgaccagcagggtaacaatcaaaacgcctttcaatgcaccgaatacgccgcccaaaatgcggttggcaaagcccaaaccgaccgccgaaactgcgctggtcagcagcgaacggagcattttctggatcagacaggcaatgacgaacagggaaatgaacgacagagccaatgcaaacaggcggggttggaacgaggcaaaggcgaggtcggcgaaggaggcggcaaagagtttggcgaaaaagaaggaaaccacccatgccgccattgagcctgcctccgcaatcacgccgcgcatcgcggatagcacgatgcaggcggcgatgacggcggagacgaggaggtcggcaatggggaggctattcattcgttacctgaccggcgataccgtgtacgcgcaatttgttcaaatcgcgttcggcatcccttgcgtttttatagttgcttgatttgacgcggtaaactttgccgttgtcggtcataatttcggtgatggtcgaatcgatacccgccgccttcattttgcgctggaggcttaaggcgcgttctttttcggcataacctgcctgaatggcggcttttttaccggatttttccttctcggcggttttggtcttgtccgctttgtcggttttttgtgccgtttcgtgttttttgccgtccgaacggtctttttcggctgtttttttgctttcagccttgtcggcttttttcgcttcttttaccgcgctgtcggattttgccgtatccggtttggttttttcggcggcagttttcggtttgtcggcaactttttcggcggttttggtttctttggctttgggcttggctttggcagtgcgttccgctttttgcggttttgtttcggcagtgcgtttcggtttttcaaccgctaccgtatccgtactgtcggcagttgccggcactttttcggcagcgcgttgttttgcctgcttcggtgcggttttggcggtttctgcctgttgcagtttctcggatgcttccaaacctttgatgttgctgtcttcgaggcgctcgttaatcagcaccagcggcgcgcctacgttttcaggctcgctgatttcgctgtcggcggcagaaggcttgtcttcgcctgccaagtcctgcggtttgtcggcggcggatttcaaggcaggggtttgtgccgcacctgccgctttgttttctacgccgcttgtttcgccggcagtctgttcggcagggccggaactgagggcggctgccagcaggatgcaggaggcggcaaccaggcaacttgccgttacgaggcggcggcggttgcgccgtttgagttgttcgtaaccgctcaggacttcgttttgtttgttttcggacatagaagtttccttttaaagtaccgacatgacatcggcaacggtatgaaatgagccgaaaacgacgattctgtcgttctcgcccgcttttgaggctgccgcccggtatgcttcgcggacggcggcgaatgtttgtatgttttcgatgctgtgttcgtgcagtttgttttgcaggctctcgagcgtcatgccgcgcggtacatccaacggtgcgatataccactcgtcaaactggtctttaacggtttccaacacgccgtctatgtctttgtcggacaacatgctgaacacggcggtgcgtttttgcgcaaacgccaaattaatcaggctgcggcgcagggcgcgggcggcgtggggattgtgtccgacatccaaaacggtcagcggccggccgggcaggacttggaagcgtccgggattttcaaccagcaacaaaccgcgcttgatggcaccgatgtccaccggcaatttgtcgttcaagcattccaatacggtcagcgcgcaggcggcattggaaagctggtatgtgccgcgcaatgcggggaagggcagggcattgcggttgcgcgcggggtcgtctgaatgttgcggccggaagcggtagttccattggatgttttccatcgcgtgaaactcgaaatcgcgctgcaccatcagcagtttcgcgcctatggcttcggcgtgtgaaagcaacgatttgggcgcggggttttgaccgcagatggcgggtttgccgctacggaacacgcctgctttttcaaagccgacctgctcgaccgtatcgcccaaaaatgcctgatggtccaaatccacgctggtaaccaccgcgcaatcgccgtcaaacgcgttgaccgcgtccaagcggccgcccaagccgacttccaatatcatcacgtcaacctgttcgcgcatgaagatgtcgacagccgccaaggcattgaattcaaaataagtcagtgatatttcgccgcgcgcggcttcgatgcgctcgaaagaggcaataatcgtatcgtccgaaacgggttcggcgttgatggcgatgcgttcgttgtaacgcaataaatgcgggctggtcagcgtaccgattttgtagcccgcctgtttgtaaatctgtgtcaggtaggcacagaccgaacctttgccgttggttcccgcgacaacgacgacggggcattgcggctcgagcttcatgcgttttttcacttcgctcgtgcgctccaaacccatgtcgatcaaaccgccgctgtgggcggtttccaaatgcgagagccagtcttgtagtgttttcatgagtgtttcgttttcaaatgccgtctgaaatcagtctgatgtatcggtttcggcggtttttttcggctgccgccaaagtacccaaactttcagcttgcggtaggattctttgtccgtcatgtcgggcatgatgcattggcggacggttttgccgccggtgtcccattgtaagaataaggcataaggcgtaaccatactgctgcccgacagtgccgccgcctttgccgttttgtctttgccggatacgatttccgcctgtccgtcgcggtctatggtaatggcggttatggcatggcggtgtttcagattcgttatcctgagcgagtatgcgtaacttgccaccaaagccgccaaaccgaaccacatcatccggccgtaaaaccaagtcaggcagacggcaagggaggcggcgtgaagcgatacagtcaggatgttcaggatgcgggacggcctcaatgccgtctgaaaggcgcgcacagccttacatcatgttgtcgaacacgggggtaatgttcaattccgcttcttccatgttcaacactatatcgtggatttcgatgtcgaaaaattcccaaaacgccttcagccccatatcttgcggccatttatccttatcgatgtcccaacctgccagctccgcctcgaaaatctgccggtagcgttcgtcgaagtaggaaacgacggcttccggttcgtcgaactgcggaacgaggaagacggaacagttggcacgaagctgctctatggtcaggtcgggcatattttcgtcggtgcttttgagccattccaaaaagcgcgcggtcggcttgaggacgacggcggtgcggtcaacaaaatacatggttttctttctcaatcatcttgcggtgtcgggatatgctgtctgaacgttcggttttcagacggtatagcatcagtgggtcatgacctgttgcaggaactgcttggcgcgttcgtgtttcgggttggtaaaaaacgcttcgggcgtttcgtcttcgaggatttgccctttatcgacgaaaatcacgcggtcggcaacttcgcgggcaaaccccatttcgtgggttacgcacatcatcgtcatgccgctttctgccaagtctttcatcactttcaacacttcgccgaccatttcggggtcgagtgcggaggtcggttcgtcaaacaacattacgcgcggttccatcgccaaaccgcgtgcaatcgccacgcgttgctgctggccgccggaaagttgggaagggaaggcgtcttttttgtgtgccagtccgacgcgttccaaaagctccattgcctttttctccgcctgttccgcattttgcccttaaccttcatcggtgcgagggtaatgttttccaacacggtcaggtgcgggtagaggttgaagccttggaatacgaagccgacttcttcgcggattttgttcaaatcggttttggggtcggcaacgttgacaccgtccacccaaatctcgccgctttcgatgctttcaagctggttgacagtgcggatgagtgtggatttgccgctgcccgaaggcccgcagacgacgaccacttcgccttttttgatttccaagtttacgccgttgatgacgtgcaggtctttgaaatgtttgtgtacgtttttgaatttgatcatgtcttttctttcagacggcatttgccgttgcaggttgtcgttacgggagctccatatgatgaagcgtgtagcgtctgccgtcaaaaaaacggtcgttcggattggtcaggcaggctgcaagcggcagtatcaggggtaaaagcaggtatttcgtcatcggcttactcccttttcagacgaccttgcccgccagataattgctcaacgccacgtatttctctggcgcgatatgttcggcgcggtcttgcggattgatgccgactgcctgcaaatcatcgtcgcctgcaagctctttcagattgttgcgtatggttttgcggcgttggtggaaggcgagtttcacgagtttggcaaaatgctcgaaatcgtccgccttgccgatgcggtgtttcaccggaatcatacggacgacggcggaatccactttcggcgcagggtcgaacgattcgggcggtacgtcaatcagcatttccatatcgaaaaaatattgcagcatcacgcccaagcggccgtagtcgttgcttttcggcgcggcaaccatacgctcgaccacttctttttgcagcataaagtgcatatcgacgacatcgtccgccacctccgccagcttgaacaaaagcggtgtggaaatgttgtacgggaggttgccgacgattttctttttgcctgcgatgccgttgaaatcaaactgcaatacatcgccttcgtgaatcaccagtttatccgcaaacggcagcgttttcagacggcatacgatgtcgcggtcgatttcgacaacgtgcaggcggttcagctttttcgccaaaggttcggtaatcgccgccaaacccgggccgatttcaatcacgacatcatccgcctgcgggcgcacggcgttgacaatatcgctgataatccgcgtgtcctgcaaaaaattctgcccgaaacgcttgcgggctttgtgttctttcatcgtgtttccttttcggttgaaaccccgccctttagggcggtagaatcagactctatttgggaggggcgtaactctttccaaatcaggatggcacatagggcggtgctttatgtgtcgtcctgtgtgttgaaacataaatgtgtttacagtatccgtttgatgtcggcattgtaaccgaaaacggcagggcgtgataatgctgtttgaaggcttgccgtgtttggcggtttggtgcaaaaaccggctgtctgccgttttgcctgttggaggattgaacgtgtctgaaaatctgcttgaaatcgaaacccatcccttcgatcccgtgttgccgccgaaggctgctgtcatgatgatggggacgtttccgcccaaggaagacaaacgcgcgatgcagtttcattatccgaatttccaaaacgatatgtggcgcgtttatgggctggtgttttttaatgatgcggcgcatttccaaaggttgtctgaaaaagcgtttgatgccgagaaaatcaaggcgtttttgcacgaacgggggattgcgtcctgtccgaccgttttgaaggcggtacgtcagcacggcaatgcgtccgacaagtttttaaaggtagttgaaaccgtcgatttggcggcggtgttggcaaaaatacccgagtgccgccatatttgtacgacaggcggcaaggcgacggaaatcctgctcgatattcagggcggcggtatcaaaatgccgaaaacgggcgaaaccgtgccgtttccgtttgccggacgggatttgacgctgacgcgcctgccttcgacttcgcgcgcctatcctttgagtttggcgaaaaaagcggcggcgtatcgggcgttttttgaaatggcgggcttgtgtgaaaaacagttataattgccgacaatttcccgttcagacggcatgtttgcaaaaacggaaatgccgtctgaaaatttgaagcacaaggaagaatccgatgaagaactaccacgcgcccgacgagaagggctttttcggcgaacacggcgggctttatgtctccgaaaccctgattcccgccttgcaagagctggcggatgcctataaggcagcgaaaaacgatcctgaattttgggaagcgttccgccatgatttgaaacattatgtcggcaggcccagccccgtttaccacgccgcgcggttgtccgaacatctgggcggcgcgcaaatctggttgaagcgcgaagacttgaaccacaccggcgcgcacaaagtcaacaacaccatcggtcaggcactgttggcaaaacgcatgggtaaaaaacgcgtcatcgccgaaaccggcgcgggtcagcacggcgtggcgagtgccaccgttgccgcacgcttcggtatgacttgcgacgtgtatatgggcgcggacgacatccaacgccaaatgcccaacgtgttccgtatgaaattattgggtgcgaacgtggtcggtgtagaaagcggcagccgcacgctgaaagacgcgatgaacgaagccatgcgcgaatgggtcgcccgcgtggacgacacgttctacatcatcggtaccgccgccggccccgcgccgtatcccgaaatggtgcgcgatttccaatgcgtgattggcaacgaagctaaagcgcagatgcaggaagccatcggcagacagcccgacgttgccgttgcctgcgtgggcggcggatcgaacgccatcggtttgttccacccgtatatcggcgaagaaaacgtgcgcctcgtcggcgtggaggctggcggtttgggcgtgaacacccccgatcacgccgcgccgattacttcgggcgcaccgattggcgtattgcacggtttccgcagctatctgatgcaggacgaaaacggtcaggttttgggtacgcactctgtttccgcaggcttggattaccccggcatcggcccggaacacagccatctgcacgacatcaagcgcgtcgaatacactgttgccaaagacgacgaagcactcgaagcctttgacttgctctgccgcttcgagggcatcatccccgcgctcgaatccagccacgccgttgcttgggcggtgaaaaatgcgccgaaaatgggtaaagaccaagtgattttggtcaacctctcaggtcgtggcgacaaagacatcaataccgtcgcgaagctcaaagggattaaactgtaacctcgtccgtctgatatagtggattaacaaaaaccagtacggcgttgcctcgccttgccgtactatctgtactgtctgcggcttcgtcgccttgtcctgatttttgttaatccactataaaaatgccgtctgaagcctgagttcagacggcattttattttgctatgaatttagtattttagaaacgaatctgtattttaatttgtccggatttttgtttttccaattgttttccttttgtaatactgccatttacgtttaatgtaacattacggtacagtaacgcggcacctgctgaatattgctgttgattatctgctttatagacgaaggaattaccgcccacattcacgccgcctttgccataattggcaaagtaagctgcagataacaagggttttacggtaaggttgccgactttaaaccgataagcaaaatccagtccggccgttagtgttttcactgacatagaacttactttaacactgtcgttacccaacttgtaatctgcagatgacaggcggctgtaacggatccccgcactggggacaatctcgaattgattgattttcagcgtattgcccaaagtaaggccggtttggatgcttgctcggttaaagtttgctttttgctgcgtttgtaaccggcttctcaagctgcctgcaccaatatcgccggccacataccaagcatcatttaaataatacttaccataaaggttggcttgcacaaaagtatttttgccgctcgcctgatcaaaagtatgctgactgtcagagtaagtcaatacgccgcctatctgcatattttcggacaagctgcggtcaatgccgatttgtgtttgcgtgcgtttcgaactaaaccggcgatattgtgcggaagcataatcacgaccataaccggtgttcgacatccaaacactgtttttttcggcatcagcgcgtgatttttgtgcaatgtgccgtgttaatgaagcacctgtatccaacaagatagattgcgtgcttgccattgcgtcagataaagccgagttggtattggtgctgactgcatcggcttgcgcggcggcttgggcttgcagctgagtggcggcttgggctcgcggctgcgcggctcttggttgcaaactcactgtctcaactttttcatgaagttccgtattgtcttgaggctgtttgtctgatgtgtcaaccgattcggatacatcttcatcttccaacgcatccaaggggatttcttcataatcattttcatatttttcatgaagttccgtattgtcttgaggctgtttgtctgatgtgtcaactgattcagatacattttcatcttccaacgcatccaaggggatttcttcatagtcattttcataccagtccggattatgcaaggccctgggtgctgcgtaagctgacgaatcaaatgatggcgagggcggtgccggcagagtagatctgcgtccgcgacgtttcggacgattttgggaagctgccatataatcctgaggtgcggcacggcgttttcggcgttgcggctgggattgggctgcttgacggtgctcttcttcctcagcttttcgtttcgccgattctgccgcttctcgatctgtttcggctttttgttttgccgacaactctgctgcttggcgttccgcttcttgacgacgtgcaagttcggcggtctggcgagcttcttgctggcgttttgctgcttcggctgctgccctttgcttggcaagttcggcggttttgcgttcggtttccgctttttgtttgacggctaactctgcagcttttcgtgcttcttcctgttgacgcgcaagggctttttgttggcgtgccgccaatgcttgggcttcagctgcggctttttggtttgccgacaattctgccgctttgcgttctgcttcctggcgatgtgcaagttcggcagcttggcgttttgcctcttcggcttctgcttttcggcgcgcagccaatgcttgagcttcacgttcggcttctgccctttgttttgccaacaactctgccgctttgcgttcttcctgctgtcggcgcgcaagttctgcttgggcttgggcaatttccacattgttttgctgtaccgaacggtgtccgcggcgtttaggacggtcttgggaagctgccatataatcctgcggtgcggcacggcgtttgcggcgttgcggctgggattgggctgtttgacggcgttcctcttccccgaccctttgttttgccgacaactctgccgcttcgcgttctttttcatgccggcgtgcaagctctgcagcttggcgttttgcctcttcggcttctgcttttcggcgtaccgccaatgcttgagcctcacgttcggcttcgactttttgttttgccgacaactctgccgcttcgcgttctttttcatgtcgacgtgcaagttcggcgctgctgcgttcttgttctgctttttggcgggtcgccagctctcttgcttcgcgttcggcttctgctttttgttttgctaactctgccgatttacgctctgcttctgcttgctgacgcttcacttgctccgcttttgcttgctggcgttttgcttcttcggcttgatttgcctgcgggctaggcggtgcgacgacgatattttgaggcttggcaatttgtgcaccgtccgtttgtgttgccttttgtgcttgagaagccgtgtttgtggcaggagacggggccggtttgactcggcggcggttctcggcataaggattgtacaatcgggtaataccgttttctgttttgattgtataacgcaatgcccctaaatctacatggttattcgccaaggaaacagaaaggcgggagcggtcttgtacggatgatgcatcaaagagattcagcccttcctgattgggttcgcctgttttatcttgaacatggagctgataatgaccggatgcggattccttcacaagcactttatccccaagatttttcgccaggtgcgtcagataatgaaaatgcccgttaccggataaatgattgattttgagcgtgtggtatttatttgcactttgcgcatcggaggcattgttcaaatgaatatggctatccgccaatgacagattgtgtacttggctgtcgccggtcaaatgccatttgctatgttggtttaggctgacacggctgtttccttgcccttgaatttgcccccataatgcagccttgcccaagaccaatgccgcattctggttcagattcacattgccgttaatctgtgtcgctccaaagctgtttaaagccttatcggataagttgcctgtgttgcaggtaacgtaaccggtatagtccgagcgcacgcaaacctcatcgccgtttttgtaacccaaatttactttggcgttgtctgttgcggtgatgttggcggtgatgtcggatacatttctgccggaagagaatgatgcggattgattaaccgcaatttctgtggctttgaatgtgcggtttatccagtcgtcttcaaatacgacttcattgtttttggagaaatgtgcgtcttttcgggctgaagatttgttcacaaaatctcttgcgtgtggtgttggacgacctgataacaagacattgccttgagttacgcttatttttccgtttaaattagtgccgcctgttaacaagaaacggttttgcgcgcttttgccgttgaaattaaggtttaatgcaccgttatgtccttttccgttttcttcgccaaagaaaccgctaaaaccgctaatacgctgattgtttttgtggttcatcgcgtttttcttggcttcttcttgtgtgctgcccattaaaatccagtcgttattttccgtttgtccgttttcgggcatcggtgcgttcacgctgccgccggattttagggcgtaataacggtagtttttgaaataaagatctttgccttgtggaatcggtttcctagggcggtaatagtaataaccagcatcgtcatcatcattattttgaatataatgaatagagatggttttgggatcggtaatcaaagatttacccgttagcgtgattgtggaggcgtggcctgtgttgtggttgacaatgcgcgcgccttcatccacgttgcggatgtgttcaaaagtcaagtcattgccattggcatccaaacgaccgccacggaaaccgaaatataggttatcgggattaatctgatttgaactatttaataccaatgtaccgcgtccgctgacaatgccgacttgggagaaagcctggacttttttgtcggcatcggcttgttgattcagaataaccgtaccgtcgccgacttttaattgcccttggttaacgcctgtgccgtttatttctaatgtgcctttgccgatttttgccaatctgtcgccattcggatttttgacttgccaaacgacttttttgccgtcggcaacatcaatccccgcacctagccaagtgatgtcattatttatacctttgactgtgtaatcgcctttgaaaaacagaccgcccgcgccttggttgatgttttgatccaataccaaagtgccgttgttttcaaaggtaacattctgtccgttgtttgcatccctttcattgttggcaagccttaccgctgtcgaaccgatatggctgtttgtgcccgtggttttccaatgatgttctccattacctttgatggtgccggcgttatcgcgttgtttgatttcatctgcaaattcttttttatagatattccattcttgccaagagtttttttgatagcctgcccaataatcgtaagcacctaaaaagacccagcgtttttcttgtttatcataagcaaataatggtgaaccgctatcgcctaacacagcatagttagtcaatgcgttttgagataaaacttctttgagtttttctggggaatgatgttttgaattatcaccgaagccaatcaagccttcttgatttagattcgatgtgacattcacgtcttgataaggcgtacctgcaatggcataacgataagctcgtgaaagctctgtcatattgtagcggctgttatattcaaattgcgtacctgctccaactcgcacaaactcagaaaaacggtttttatctttataggtttcaacgccgccgcctgcactggttggtgcaataggtgcgacttctgttacgaatttattaaggcgtgccatgttgtagtcttcaagacgaccttgattaccgtgatgccaatttttatttggttcgtagtcattttgtgcaactgaacgatattcgttttcatcattgctaacatctaagtgcccattgtgatgcccgtaataagagatttcgtctccttttacatgtttgacgctgacggcatactggggatcgatgacggttaatgtacgtctgttgacatctgcaacgctaaaatcaatcatcggtacgttggataatgcgttgccgatgttttgaccttgtttgtttttcactgataaatcggttgcgccgacaaaaaatttgcctttgttttctgcaaagtcacggaatatttgataatcgacatcgtctctgaccaatgccgcttctgagtatggcgtaagggcataggcaagaaagatggataaggatatggcgttaattttaaaacgtttggttttcataaggttttaccgttttaagggtgataatgttttgtattttacgccggtttggtggtgttgactattttttgttgtgtaaatcattcattttggtgttttattgccaatttaaaaaaagaatcccgatgtttttatttccgcttcctttgttctgttattcaagcgaaggcgggaagccgattttcggggttcggttcttccgttaaatttctgcggctttttgtttttggattcccgcttttgcgggaatgacgggattttaggtttctgattttggttttctgtttttgagggaatgacgggatgtaggttttcttaaccctgagtcctagattcccgctttcgtggtaatgacgagatgggggttcgtgggaatgacgcggtgcaggtttccgtacggatggattcgtcattcccgcgcaggcgggaatctagaccttagaacaacagcaatattcaaagattatctgaaagtccgagattctggattcccactttcgtgggaatgacgggattttaggtttctgattttggttttctgtttttgtaggaatgatgaaattttgagttttaggaatttatcgggagcaacagaaaccgctctgccgtcattcccgcgcaggcgggaatctagaccttaaggcagcggcaatattcaaagattatctgaaagtccgagattctagattcccgctttcgcgggaatgacgaaaagtggtgggaatgacggttcagttgctacggttactgtcaggtttcggttatgttggaatttcgggaaacttatgaatcgtcattcccgcgcaggcgggaatctagaacgtggaatctaaagaaaccgttttacccgataagtttccgcaccgacagacctagattcccactttcgtgggaatgacgggattttaggtttctgattttggttttctgtttttgagggaatgacgggatgtaggttttcttaaccctgagtcctagattcccgctttcgtggtaataacgggatgtgggttcgtgggaatgacgatggaaagtttgccgttgtctcggataatactgaggcttttcgtttgcattcttatagtggtttaacaaaaaccagtacagcgttgcctcgccttgtcgtactgcttgtactgtctgcggcttcgtcgccttgtcctgatttaaatttaaaccactatatcattttcaaatcttgttatgacggtttttcggatttgctttattatccgtttatttttgaaatatctggggtggggagacgtgttccgtcgttggtttttgccgtgttgggttgtcggcgcggcggcttcgtttgcgctgccggtcgtgccgcattggctgttttggctggcggcttttgcggtttttgctgtgtttgcaaggcgttttgcgtttgccggtctgatgctgtgcgtgttggcgggcgcggcttacggcgtattcagaacggaagcggcactgtcttcgcaatggcgggcggaggcggtttcaggtgtgccgttgacggtggaagtggcggatatgccgaggtcggacgggcggcgcgtgcagtttgcggcaaaggctgtggacagcggtggtcggacgtttgatttgctgctgtcggactacaaacggcgcgaatgggcggtcgggagcagatggcggataacggcacgtgtgcaccccgtcgtcggcgaattgaacctgcgcggtttgaaccgtgaggcgtgggcattatccaacgggataggcggcgcggggacggtcggtgcggacagggttttgctgcatggcggaagcggttgggggattgcggtttggcgcagccgcatcagccgtaattggcagcaggcggatgcggacggcgggctttcagacggcatcgggctgatgcgcgcgttgagcgtgggcgaacagtcggcattgcgccccgaattgtggcaggcgttccgaccgttggggctgacgcatttggtcagtatttcgggtttgcacgttacgatggtggcggtgatgtttgcgtggctggcgaagcggctgcttgcctgttccccgcgccttcctgcccggccgcgcgtgtgggttttggcggcggggtgtgcaggcgcgctgttttacgcgctgcttgccggtttttccgtgccgacgcagcgcagcgttttgatgttggcggcgtttgcgtgggcttggcgcaggggaagattgtcggcgtgggcgacgtggtggcaggcgttggcggcagtgctgctgttcgaccctttggcggtcttgggtgtggggacttggctgtctttcggtttggtggcggccctgatatgggcgtgttcggggcgtttgcacgaagggaaacggcaaaccgccgtgcgcgggcagtgggcggcttcggtgttgtcgctggttttgctcggttatctgtttgcttcgctgcctttaatcagccctttggtcaatgcggtggcgattccgtggttttcttgggtattgacgccgctggcgttgctgggttcggtcgtgccgtttgcgcctttgcaacagttgggggcatttttggcggaatatactttgcggtttttggtgtggcttgccgatgtgtcgcccgagtttgccgttgccgccgcacctttgccgctgttggtgttggcggtgtgtgccgctttgctgttgctgctgccgcgcggcttgggtttgcgtccgtgggcggtgttgctgttggcagggtttgtgttttaccgttcacccggcgtgccggaaaatgaggttgcggttacggtttgggatgcggggcagggtttgtcggtgtcggttcagacggcaaatcatcatcttttgtttgacactggaactgcatcggcggcacagacggggattgtgccgagtttgaatgcggcgggtgtccgccgtttggacaagctggttctgtcgcatcacgacagcgaccacgacggcggttttcgggcggtgaggaatattcccgccggcgggatttatgccgggcagccggaattttatgagggggcgcggcattgtgcggaacagcgttggcaatgggacggcgtagatttcgagtttttgaggccgtctgaacgcaaaaacatcgatgataatgggaaaagttgtgttttgcgtgttgtggcgggcggtgcggcactgctggtaacgggcgatttggatacgaagggcgaggaaagcctggtcggcaagtatggaggcaacctgtacagccaggtgttggtgttggggcatcacggcagcaatacgtcctcgtcgggcgtgttcctcaatgccgtttcgcccgaatatgccgttgcttcaagcggttatgccaacgcctacaaacatccgaccgaagcggtgcagaaccgtgtccgcgcacacggcattaaactgctgcgtaccgatttgtcgggtgcgctgcaattcggcttgggacgcggcggcgtgaaggctcaacgtttgagagggtataaattctattggcagaaaaaaccgtttgagtgaggtttgaaacataaaatgccgtctgaaacggattcagacggcattttggcgttaacgccggttcgtgctggcaaggcatatcgtttgattttcagtgtgcgtcaaaaacagaaagggcgttgcggttaacggcagggagaaccgtttgaatgaacggaaaggtttgcgccagaaggggaaatgccgtctgaaagggcttcagacggcatccggacatcggtgcggaatcagtgccagtaacgccaccagggcatatcgtcagatcgccacggctgctttaagaacgggcttttcgggaagttggtttccaacacgcggcgcgtatcggcggcaagccggggcttgtccaacttcttgtaggcaagttccaatatggcgagcgattcttcgacatagcgtgtattttgatagctgccgataattttttgggcgcggttggcggcggcgatatatgcgccgcgtttcatgtagtaacgcgctaccgacatttcattgccgcccaaagcatcgaccagtttgaccatgcgtgcggtcgcatcggcggcgtatttgctgttcgggaagcgttggacgagttccgcaaaggcctgatacgcttcgcggttggctttcgggtcgcggtcggaccagtcttgcgaggccagcttgttcaagaaagattgatcttcgttgaacagtaccaaaccgcgcaggtatagcgcgtagtccatattcgggtgttgagggtgaaggcggcggaagcggtcaatggcggccagcgccttatccttctcatcatctttatagtaggcgtatgccgtatccagttgggattgctgggcatggcggctggtagggaagcgcgattccaagatttcgtataatttgacagctcgcgtataattgctgctgttcagctcgtcctgggcttcggcatagagtttttccacactccagtcttgggtaatctgggcatctttatctaccgtaccttgagtggcacaggcactcagtgccaaacctaatgaaaccgttaaaagaatttttttcatgcagaatacttcctttgataatgaatccgattatagcgacgattcagactttgcgtcagcttccgaaactgaaaaccgtatcggtctgaccgttccgctcgagcttgcaggcgggcggttggatgcggtattggcgaaacttctgcccgactactcgcgcagccgcctgacatcatggattaaagaaggcgcggttattgtaaacgataaaccttcgcaacccaaagacaaaatgataggcggcgagcaaatttgtgtaaccgtccgtccgagtgaggaaaatctggcgtttgttccagagcctatggctttggatattgtttacgaagacgataccgtcatcgtcgtcaacaaaccggccggactggtggtgcatccggcggcgggcaactggacggggacgctgctcaacggcctgttggcgcactgtcccgaattgagccaagtaccgcgcgcgggcatcgtacaccgtttggacaaggaaaccagcgggctgatggtggttgccaaaaccctgccggcgcaaaattccctcgtgaggcagcttcaagagcgcacggtcaaacgcatctaccgcgccgtcgccaacggcatcgtccccttcgacggtaaaatcgaaacccaaatcggacgcgatccgcacaaccgcctgaaaatggcagtcgtcaaattcggcggcaaaccagccgttacccacgtcaaagtgttggaacgctatcttacccacagctatatcgaatgctcgctcgaaacgggcaggacgcaccaaatccgcgtccatatgcgcgaggccaaccatccgcttgccgccgacccggtttacggcaacccgcgccatccgtgcggcgacacggtgaaagaagccgttaaaagtttgggtgcgcgtcaggcgttgcacgcctaccgcttgagtttcacccatccggaaagcggcgaaaccgtttcgtttgaagcaccgattccaaacgacatatatcatttgttatccgtcctccgtcttgaagccggtttggattcgtctttgagcaatgaagaagaatggcaggacaaattcggcgcggacgacgacgatgattggaacgaagacgactatgatgtcgaagtggtttatgtaagggagtgaggcggcttgaaaggcggggcgaacgcaggcagccgaatcggagcagccgggcaatcgtccccgccgatttcaaacaaaggccgtctgaagggaccgggcagaaaccgccggttttgtttgccccgttcagacggcattatgataaaaggcgtttagggttttttatgtttaccggctttggccgcccaataagttgccagcagcgagccggagatattgtgccacacgctgaacaatgcgcccggaacggcaacgaccggcgcggcggcaaagtgtgcggcggcaagcgcggcggccaggcccgagttttgcataccgacttcgatggtcagcgttttttgtgcatcataaggcaggccggtccatttggcggcaaagaagccgagcaggtagccgatgccgttgtggagtacgacaaccgcaaaaatcagcaggccgctttccataatcttgcctttgcttgccccaacaaccgcgccgataatcagcacgatggcggcaacggaaaccagcggcagcgcatcggtcagcttttcggttttactgcccaaaaccttatggacaatcaaacccaaaacaatggggagcaaaaccattttgacgatggacatcaacataccggccgcttggatttccagcatttcgccggcaagcatcaggaagatggcgggagtcagcaatggggaaatcagggtggaaacagacgtaacggcaaccgacaaagccacattgccacgcgccagataggtcatcacattggaagccgtaccgcccgggcagcagccgaccaaaatcacgccgaccgcgatttcggcaggcaggttcaacagtttggacagcagccaggcggttgccggcataatggcgaattgtgcgattacgccgatgatgacgactttgggatgtttgaacaaaatatcgaagtcggaaggtttgagcgtcaaacccataccgaacataataatgcccaacagccaaggaatataaggccccgcccatttgaaggtgtcgggcgcgaaaaaagcggcggcggcaaagagcgcggcccagagggaaaatgtttttctcgataaagctgctgattttactgaggatattcataaataatgcgttgcgtgtttg

SEQ ID NO: 37833 - DNA, 520 bp, Neisseria meningitidis
  misc_feature (1)..(520): N is any nucleotide
atgacgncatagggntttccgttttcccgataaattaccacaacccaaaatcccgtcattcccgcgaaaggatatatccggctcgttcggtttcagttttttaggtttcaggcaacttctgantcgtcattcccacgcaggtgggaatctaggtctntccgcacgggaacttatgcgcngtcattcccgcgaaaggggatgccagattcttcggtacagaaacttatcggataaaacggtttctttagattctacgtcctagattcccgcctacgcgggaatgacgatggaaagattgttgttgcttcggataaatttctgcagttttaaataaccngattcccgcctgctcgggaatgacggcataggtttttttgtttttccgataaattaccacaacccaaaatcccgtcattcccgcgacggcgggagatccagtcctttaaactccagccattcccgataaattcctgttacttttcgtttctagattcccgattttcgngggaatggatggatn

SEQ ID NO: 37834 - DNA, 10000 bp, Neisseria meningitidis
catggtttggatatccatgctgctccctatgtacataataaaaaaatggccccgtggccatttttcgtcaaagttgaaaaatcggcgtgattataaccgcttttgcggagaaatgaaagtgttgatttattttgtgtttttgggacggaaaaaagcgggtgtaagggaggtttgtaatgggaaatcgtgaatattgttgacaaaacaaatgtatctatttgtcgcgtgcatgatttttatgtttgtaaatcaatatattgatattattttccgtgttcgggcggcatggaatcgggcggaggacaggtattttccatccttgcacaaagcctgctgcaagcctaaaatcgggcgggttattgttcagaatcaaggctgcatcatgtctctttatccgatttacaatttttccgccggccctgccgtattgcccgaagccgtgttggaaacggcgcggcaggaaatgttggactacaacggtacgggttttcctgtgatggcaatgagccaccgttcggaaatgtttttgagcatcctgcatcatgcggaacaggatttgaggcagcttttgaaagtgcctgacaactataagatattgtttctgcagggcggagcaacaacccaatttaatatggcagccatgaatctggcacacggtttccgcactgccgacgcggtggtaacgggcaactggagccgtatcgcttatgaacagatgagccgtttgaccgatacggaaatccgtttggcggcgcatggcggcgagcagttcgactatctcgacctgccgcctgtggaaacgtgggatgttgcacccgattcggcgtttgtccattttgccgtcaatgaaacggtcaacgggctgcaataccgtgaagtgccgtgcctttcagaaggcatgccgccgctggtgtgcgatatgtccagcgagattttgtcgcgcgagtttgatgttgccgactacggactgatttacgcaggcgcacagaaaaacatcgggccggcaggagttacggtggtgattgtgcgtgaggatttgctcgagcgttgtccgaacgatattcccgatgtgttcaactaccgttcgcacatcaaccgcgacggtatgtacaacacgccgtcaacttacgcgatttatatgtcggggctggtgttccgctggctacaggcgcagggcggtgtgaaaaaaattgaagcggtcaatcggctgaaggcgcaaaccttgtatgagacgatagacggcagcgatggtttttatatcaaccgtatccgtccgaatgcgcgttctaaaatgaatgtcgtgttccaaacgggggatgaggagcttgaccgccgttttgtgctggaagccgaattgcagggcttgtgcctgcttaagggctataaaaccgtcggcggtatgcgtgccagcatttataatgcgatgccgcttgaaggcgtgcgggctttggcagattttatgcgcgatttccaacggcgttacggttgatgtcccgatgttgtctgaagcggcttcagacggcatcggctgtttcggcgttctccggcggcgttttggaggtggtaagattgtgctgccggcggctatccgtccttttcaatccgagcgtgatgctgtttgtgccggactgtcccgtcggcggcgcggctgggtttttccaatatgaaatgctttgcccgtttttctggcaggggcggttgcagaccggttcgaatcttgcttacgatgtttttatgtctgccggacgtttgaatggcgggcggaaccccccgcacagccgccgttttcttgccctgctttgctccgttgccttataattaagaatctttttcaataatccggattccaaatgccggatgccttttccaacccttatccgacacattccaaatgataaaaccgaacctgaggccgaagctcggctcttccgcgctgattgccttcctttccctgtattcctcgctggtattgaattacgccttttttgccaaagttgtcgagcttcatccttttaacggcaccggggcggatatcttcctctatacgatgccggtggtgctgttttttttaagtaatttcgtttttcacgtcattgccctgcctttcgtgcataaggtattgattccgttgatattggttatcagtgcggcggtgtcttaccaagaaatatttttcaatatctatttcaacaagtcgatgttgaataatgtcttgcaaactacggctgccgaaagcgcgcgcctgattacgccgggctatgtgctgtggattgtatgtttgggcgtattgcccgcgctggcgtatatcgccgtcaaggttaaataccgcgtttggtataaggagcttttgacgcgccttgtgcttgccgccgtttcctttttgtgcgcgttgggcatcgcaatgttgcaatatcaggattacgcctcgtttttccgcaacaataaatcagtaacccatctgattgtgccgtctaatttcatcggcgcgggcgtgtcgaaatacaaagattggaagcgttccaatattccttatacgcaattggatatggcggtcgtgcaaaaccgcccggccggcagcctgcgccgtttcgtggtgctggtcgtgggcgagaccacgcgtgccgccaactggggtttgaacggttacagccgccaaactacgccgctgcttgccgcgcgcggcgatgaaattgtcaatttcccgcaggtcagaagctgcggcacatcgaccgcgcactccctgccgtgtatgttctcaaccttcgaccgcacggattatgacgaaatcaaagccgaacaccaagacaacctgctggacatcgtgcagcgcgccggcgtggaagttacttggttggaaaacgattccggctgcaagggcgtgtgcggcaaagtgccgaataccgacgttacctcgctcaacctgcccgaatactgccgcaacggcgagtgcctcgacaatatcctgctgactaagttcgacgaagtcctcaacaaaaacgataaagacgcggttttaatcctgcataccatcggcagccacgggccgacgtattacgaacgctataccgaagccgaacgcaaattcacgccgacctgcgacaccaacgaaatcaacaaatgcacccgcgccacgctggtcaacacttacgacaatacggttttgtatgtggaccagtttatcgacaaggttatccgcaaacttgaaaaccgcgacgatttggaaagcgtggtgcattatgtttccgaccacggcgaaagtttgggcgaaaacgggatgtacctgcacgccgcgccttacgccatcgcgccttccgggcagacgcatatcccgatggttatgtggttttccaaagccttccgccaacacgggggcatagatttccaatgcctcaaacaaaaagcggcggaaaacgaatattcgcacgaccactatttcagcacggtattggggctgatggacatttccaatagccaaacctatcggaaggaaatggatatattggcagcctgccgccgtccgcgctgatgccggatatgccgtctgaagccttcggacggcatatgtgtccgaacacccgaccgatgaccggagtataacgatatggatgctttaaaattattgacgaaccgccgatcttccaaaaagctgaagcaccccgcccccgatgcggcggagttggaacaaatatttcaggcggcaacccaagttcccgatcacggcaatatgcgccccttccgttttaccgtgattcaaggcgaggtaggattgcaacgttttcgcgatgtgttgaagcaaacggttgccgaattgaatttcggcgacgatgcgatgaaaaaggcggaaaaagtgggcaatatggcgccgatggttatcggggtaacgtttgcgccgaaccgcgatgtgcctaagccgaaaccggaatgggagcagatgctgacggcgggttgtgcggcgtatgcgctgcaactggcggcaacggctcagggattcgacaatgtctggattacggggatgtgggtcaatagccccctgttgcgggaggctttcggttgtgcggataaggataaaatcatcgggctgatgatggtcggcacgccgacagaggaagtgcataagcccaagaataccgatttggaagcgtttgtcagccattggtaaacggaatctcaagcacaatgccgtctgaaaggctttcagacggcatttttccatgcgttttaaaccggattcatgaaacgcccgatgcgttcggcggaaatgtcgggtgtcgcgccatgttcggaggcgaccagcgtaccaagtacgcaggcaaaggtctcatgccgtctgaaggttcagacggcatcggtatcggggaatcagaagtggtagcgcatgcccaatgagacttcgtgggttttgaagcgggtgttttccaagcgtccccagttgtggtagcggtatccggtgtccaaggtcagcttgggcgtgatgtcgaaaccgacaccagcgatgacaccaagccccaagctgctgatgctgttgctttcgtgataggcaggtttgctactcggtctctctgggatagtgcctcccactgtagcgtctcccgttggtgcagtggtataaatcgtggttttggtttccaccgaatgaacctgatgtttaacgtgtccgtaggcgacgcgcgcaccgatatagggtttgaatttatcgaatttatcgttgagtttgaaatcgtaaatggcggataagccgagagaagaagaggcgtggaacgtaccgtttccctgattttccgtcttcagttttatcctgttgccctggttttctttcaacacttttgtgttgacggaatatttattgttgctccattttctgtaactggcataatctgccgctatcctccagccgccgaaatcgtagccgactgacactcgggggtggatggaatgcgcacggatgtttctgaaataatcgcttactgtgcttattttgtctttgtctgtaccggttgctttcggataatcgtgggtaatacgttcggcggcataagctaaatccgcctgcacataatacgggctgcggctgccgtcttcacttgccgcctgcgctgcggaagagaagagaagagaagagaagagaagagaagagaagagaagagaagagaagagaaggttttttgggggctggattcattttcgactccgtattcggttttaactgattaaaaagaaagattttcaatgatgttgcaggagcggactatatcaggtttgtggcgatgtttcaacacaatatagcggatgaacaaaaaagagaacgattctctaaggtgctgaagcaccaagtgaatcggttccgtactatctgtactgtctgcggcttcgccgccttgtcctgatttttgttaatccactataaggaccgtcgggcatctgcagccgtcattcccgcgcaggcgggaatctggaatttcaatgcctcaagaatttatcggaaaaaaccaaaacccttccgccgtcattcccacgaaagtgggaatctagaaatgaaaagcagcaggaatttatcggaaatgaccggaactgaacggactggattcccgctcaggcgggaatctagaatttcaatgcctcaagaatttatcggaaaaaaccaaaacccttccgccgtcattcccacgaaagtgggaatctagaaatgaaaagcaacaggaatttatcggaaatgaccgaaactgaacggactggattcccgcttttgcgggaatgacggcgacaaggttgctgttatagcggattaacaaaaaccagtacggcgttgcctcgccttagctcaaagagaacgattctctaaggtgctgaagcaccaagtgaatcggttccgtactatttgtactgcctgcggcttcgtcgtcttgtcctgatttttgttaatccgctataaagaccgtcgggcatctgcagccgtcattcccgcgcaggcgggaatctagaccttagaacaacagcaatattcaaagattatctgaaagtctgagattctagattcccactttcgtgggaatgacggttcagttgctacggttactgtcaggtttcggttatgttggaatttcgggaaacttatgaatcgtcattcccgctcaggcgggaatctagaatttcaatgtctcaagaatttatcggaaaaaaccaaaacccttccgccgtcattcccacgaaagtgggaatctagaaatgaaaagcagcaggaatttatcggaaacgaccgaaaccgaacggactggattcccgctttcgtgggaatgacgggatgtaggttcgtaggaatgacgtggtgcaggtttccgtgcggatggattcgtcattcccgcgcaggcgggaatctagactttagaacaacagcaatattcaaagattatctgaaagtttgagattctagattcccactttcgtgggaatgacgggatgtaggttcgtgggaatgacgtggtgcaggtttccgtgcggatgaattcatcattcccgcgcaggcgggaatctggaatttcaatgcctcaagaatttatcggaaaaaaccaaaacccttccgccgtcattcccacgaaagtgggaatctagaaatgaaaagcagcaggaatttatcggaaacgaccgaaactgaacggactggattcccgccttatatgatgcgctctatcaaaggggcgcattacttttcttaacattcccctttgacagccaagtgaaaggggcttttttatgtcagtagcaaatgtaatattttcttgttcctattggagaatatttaaaaaatcagattattgcgttttatgtttctatcagttcaggcatggtgaaccgcataaactcgctgaacaagaaaatttttcaaagctttatcaggcgttcgattatatagattcggttggctcgaattttccggtaattatcacaacagacggttgtggtctttcttcttgatctttaacagtttgtcaggattgggctttcggtcgttgaccgttggacgcgctttagcgcggcagacgggaaacggctgaaagcccccccctgactaacagggggggagcgaaataaaacaaatccctaaaggtactgaacaaaatgagtgaagcagaatatttttcccatttcatatctaacggcaatgggaagttattagaaattccgcaacgtaggggcaggcaggacggcgtttttatagattggttgtcattcacactgcacgaagattccttgctgaaagtttccggatgccccttagtttccgatgccgaatatatgtttgttttaagcaaaaaattggaggaaatattagggtttggcatcacgagcagatgcaaatcgaagggcaataaattttacgattcgatgtttaggttgggatcggaagaagttgactacggcgaagtccattacggaggtcagcgaaatacggttttaatcgaattgaaaggtgtaggttgcaacattgcaaatccaggttgggaattgaggcttaagcagtttttggaagattcattgaggccgaggataacgcgggtagatttggcacttgatttttttgatggggagtacacgccggaacaggcacttttggatcacgataacggttttttcgataacagtaacatgaggccgaaatctgaaatggttggaacggcttggcggagagaggacgggagcggcaagacattttatgtaggtcgcaagaaaaattctcgttttgtgcgtgtttatgagaaaggcaggcagctaggcgataaagaaagcaagtgggtaaggttcgaaattcagtttaatcatggagatatggaaatacctttggatattctgataaatcaaggttcttacttttcaggcgctttcccgatttgtcagaaatttaaaaatatgccgaatccggaaaggttcgattaccgtaaaaaagtggctaatttaacttttcagcataaattgagatacgcaaaaaacgcggtcggcaaactgattaatttcatgtttgatatgggttttgatagtgatgaaattgtcagatatctgaaggcagatttggggtatcccaaagggctagaacctgaaaaatattcgttggccggattgaaggaatctttgaaattcggctttatccacgaacaaccggatgtagatttagaggttgaattggaagaactcggaattatcaaatttaagcaatcagataaattcgatccggataaaaggcttttcgatccacatcacgatgtggaaagtgagaggcaatatcagctttatctcgacagaatgtatgatcttcatgcaaatcaaaattaacctaaaaaggaaaaattaatatgtttaatcaaactcaaactgtaacttatcccgcaacttttttaggagctaaaaaattcaaaggcgaaattgatggctctaatatcgacacttgttccgtattggttgcaacacctttgccggcacagtcgggaaatgctgttggattcacggcagcacaaatgaagttcggggacagtaagaatttctcaaaattagagaatctcaaatacccgtgcgaagttatggtaacggttgaaatgacttcgacaggtaagggcatggttccttcattaattgattttcaggtggcagaaaagccgaaaggttgatttatgaaatttgaagaacgtttcatagttcaagacttggaaacgcatgactttatttatcccgatcctttcggtgatgtggggtttactcaaaatattaaatcagcaggtcaatttgaaagctacgaagatgcgttgaattcaggcataaatgaaataggcggaggattccagatatttcagttcttcgtaaaatcggaataaaagaaaaacaggctcggcgggcggtctgtcaacctttcacaaagcccgcaacaaaggaaaaatatcatgaaaatgaaccttgcaacactaattatcggctgggtggtctgtatgtttctttttcttttcgcaatcctctattttatcggctaaaaacgagattcggaaaagacttcgtccggatgaagcaagtcaagaagtcgtcttattttaaatatcaaaaaaggaaaaaaacgatgaacatcgttaaaaaatacgctgtaaaagcagccttggcagccggtatcttcacaccggccattgttatggcagatacctttgatccatccgcgattggtacgcaagtagcgaatgtaatcatgggtttcgtgtcaatggtttccgccgtgggtatggcggccattaccgtgattcttgcaatccaaggcttcaaaatggcttggagcatgattaaatctgtcaaataaacagagtgaagaaaaaggggcgtataaatgggctatcgtgtcggcataaattgttttgatacaagattgcatgcagacgactatttattgtcgtcccttcctcctactgttacccaggacggaaaaatcatcaggccggaaagggtgggcgaaaaatgggtcttgaacggaaagccggtaatgttgtcctatccgaaatgttccaattttgagcagatcaaacagggttcttatgtcggttcgacggttttaattctgttcgtagtcatttacggcttcaggcttttgattaattttttaaaagacatgggcaaggttgggattgattgatggttattgatttttggtttcttctcggtttcttcttggctttgtctgtcgctttgatatttaaatgacgtgttttaaaatcaggctttcaaaacaacctttgaaaggcagaacaatgaacaaaccgtttatcacgcaggcgcagttggcactttataaatatcagccgtcaagcaagtattatggtaaaacaatggcatatactttcgctagtgagcttttggattattcaaaagttaataaatttataattcatgaagaaatccaatgttttttaaatagaaggatttctaataatatttggaaaatttatttttctgatgagtctgtygcgtatataaaaat

SEQ ID NO: 37835 - DNA, 21091 bp, Neisseria meningitidis
caatgcggattcgcagcaggagttggaggcgctgccgggcataggcccggcgaaggcgaaggccattgcggaataccgtgcgcaaaacggtgcgttcaagtctgtagacgatttgaccaaggtaaagggcatcggccctgcggtgctggcgaagctgaaggaccaggcttcggtcggcgcgcccgcaccaaaagccccagccaaaccggtgctgcccgcggataaaaaataggggaacctgtaaaggaaagggcatcggccgccgtcggtgcttttttgtttggaagggaaatggctaaaatatgtagcattatgttctgtatcgttgtttaccgcttccgcacctttgtccgccttaaagcaggtagacaccgcaatgaatcgacgcaaagaaaatgccgtctgaacatgcgttcgggcggcgttttgttggggggtatcggagcggaacgtctgaaaaagggtttcaggcggtctttgggcgtgtggtgacagtcgaaaacgtgataaggctacctgaaaagtttgggagattttcaggtagcctttggtattgggcgcaacagacgcaggtacagattagcggtgtgccgtaatcgtacgaatgccgattcaacctaagcagacatcagtatttaggaagtggatgtttgatggagcaaaggttgtaccaagggtggaaggcaacctgtgggtgtttggtatggtcgcgcttgaaaaaacgtgttttaagggacaaatgccgtctgaaaatcggtttcagacggcattttctgtttatttaaagcaaacaggaaaaggcagcaatattctgcagtcttcctattcacacaagcgttttatagttaattaaaaacaaaatagtacaatactcaactttgaaggtctaaccatggcatactctgcggacttaagaaacaaagctttaaactaggggctgtactagattagcagatatgttaccctcgaaatatgaagataacgcactgcaaattaaagaaaaaagtacagaaagaactgctccgttttttgtgctggaagttaccgcccgttctgccgccgatattttgggtatccatcccaattcggcagtactgttctaccgtaaaatccgcacggttatcaaccatcatttggccttggctgccgatgaggtttttgagggccctgtcgagccggacgaaagcgatttcggcggacggcgtaaaggcagacgtggtcgcggtgcggcaggaaaagtggttgtcttcggcattctgaaacgcaacggacggggctataccgttgtcgtagataatgccaagtctgaaacgttactccctgtcatcaaaaagaaaatcatgccggacagtattgtttataccgatagtctgagcagctgcgacaagttggacgtgagcggttttatccattaccgcatcaaccattccaaggaatttgcagaccgtcagaaccacattaacggcattgagaatttttggaatcaggcaaaacgcgtcttgcgaaaatacaacggaatcgatcgtaaatctttcccgctgttcttgaaagaatgcgaatttcgatttaacttcggcacaccgtctcaacagcttaaaatcctgcgggattggtgtggaatttagggctaatctagtacagcacctaacaaaaaccagtacggcgttggctcgccttagctcaaagagaacgattctctaaggtgctgaagcaccaagtgaatcggttccgtactatttgtactgtctgcggcttcgtcgccttgtcctgatttttgttaatccactatattttagataatgcgtgatttcaccgtatgggtgtcttacgggaaatggcggaaaaattgggacataaggtattgcctcttgcaccttattcacctgagctcaacccgattgagaaagtgtgggcgaatattaagcggtatctgcgaaccgttttgtctgattacgcccgatttgacgatgcactactgtcctattttgattttaattgactatagaacgttgcggctacgcggaagccgtactcgttggatttggagcggcccattttggttttgtcaccgtccaagacaatctcacggggtttgtagattgttttgtgacggtagtatggatcaaactcgagaccgacgctgtcggtcaactgtttgcctacattcagaccgataccgacactccaacctttggcgcttttgctgacatcgcgggaagcacccatctgggtcgtcatcactttggttttgccgcgcaaatctgcatatgcatccgcccaaggggtcagggatcatccgtcccccaaatcttggcggatttcgccatggactttcaaagcaaggttttcatgcttggtaacggtgtttttccttatcgccgatgatggctttgcctttgccgttagactcgggaatatcggctaccgtaacggcggacacggctgcaagtgagagtgcaagcagggttttttcatgtttttcttcctataatgaggataaataaatggaaaaagtgtgggaaatacccgcattcccattaaatcttttttcaagcaatgagttctttttgttttcaacattttccttgagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctctccttgtgtatgaaattttgccggatgtgaaggcggaatcggcagcgggggtgttctgtaccggattgtcgtggaaatgggaaaacggatgttccgtgcaggtttgtccaaatgaatggcgggtattgtttttatcaatctgtttctttttatttgaaataaaatttctaaaataataaaaatatgaaatttaaaatctataaaaaaagatatatcagttattttgaaataaaatagctttgtagtaatatgttgcacttgtttgtgcaaggtaaacgatgtaacctaagccgcgtataaaaacccatcaggaaagatgcaagatgacacaccattaccccacagacgatattaagattaaagaagttaaagagttgttgccgccgatagcccatctttacgagctgccgatttccaaagaggcttcgggcttggttcaccgcacccgtcaggaaatttccgatttggttcacggcagggacaagcggctgttggttattatcgggccgtgttcgattcacgatccgaaagcggcgttggaatatgcggagcgtttgttgaaactccgcaagcagtatgaaaacgagcttttgattgtgatgcgcgtttatttcgagaagccgaggacgacggtgggttggaaaggtttgattaacgacccgcatttggacggtacgtttgacatcaatttcggtttgcgtcaggcgcgcagcctgttgttgtcgctgaacaatatgggtatgcctgcctctaccgagtttttggatatgattacgccgcaatattatgcggacttgatttcttggggggcaatcggtgcgcggacgaccgaaagccaagttcaccgcgaattggcaagcgggctgtcctgccccgtcggctttaaaaacggtacggacggcaatttgaagattgccatcgacgcaatcggtgcggcgagccattcgcatcatttcctgtctgtaaccaaggccgggcattccgccattgtccataccggcggcaatcccgactgtcatgtcattttgcgcggcggcaaagagccgaattatgatgcggaacacgtcagcgaggcggcggaacaactgcgtgcggcaggggtaaccgacaagctgatgatagattgcagccacgccaacagccgcaaggattacactcggcagatggaagtggcacaagacattgccgcccaattggaacaggacggcggcaatatcatgggcgtgatggtggaaagccatttggtcgaaggcagacaggacaagccggaagtgtacggcaagagcattaccgatgcgtgtatcggttggggcgcgactgaagaactgttggcattgttggcaggtgcaaacaaaaaacgtatggcgcgcgccagttgagatttttgacgcagaatgtcataaaatgtcgtctgaagcgttcagacggcatttttgtggaggaaatatgctcaaaataaccctaattgcggcgtgtgcggaaaacctgtgcatcggggcgggcaatgctatgccttggcacatccccgaagatttcgcatttttcaaagcctataccttgggcaaacccgtcattatggggcggaaaacgtgggaatccctgcccgtcaaacccctgcccggacggaggaacatcgtcatcagccggcaggcggattattgcgcggcaggcgcggaaacggcggcaagtttggaggcggcattggcattgtgcgcaggcgcggaagaagccgtcattatgggcggcgcgcagatatacggacaagcgatgccattggcgaccgatttgcggataaccgaagtggatttgtctgtggaaggagatgcatttttccccgcaatagaccggacgcattggaaagaagcagagcggacggaacgccgtgtcagcagcaaaggcacgcgctatgcttttgtgcattatttgagatattgaaatataaactctctataaaatcccccgcaaatgatgggctgaaatagaaaatattgttattcccccgaagatgggaatccgggattttaaagttagggtaatttatccgaaataacaacaatcttccatcgtcattcccgcaaaagcgggaatccggaaacgaaaagctaaagcaatttatcggaaaaaaccgaagtttaaagaaccggattcccgcctgcgcgggaatgacgagattttaggttatggggatttattgggaataatggaacaaagaaagcagaaataaggatatagaggctgtctttggatttgcgatggttgtcggagaatgccgtctgaagccgtttcagacggcatttttccagcttgagaacggatgcctgctcaaataagcattggtaaacataccgtcggcagtgatttcccgtcccagccagtccggacggtcaaaatcggcattctcgtcgggcaactcgatttccgcgacgaccaaaggcgcattatcgccaagaaaaacatcgatttcaaacaggctgccgccccatctgaccggataacgccatttttccattttaaacgggcacatcgtttccatcatcttttccgcatcggcaagcgggatttcgtattcaaactcactgcggctgatttccgaaatatagcctttcagcgtcagccacgcctgttttccggcaatgcggacacggacggtgcgttctttttcaacagacagataaccctgcctcaacagcagcggttcgtcggcgtattgccgccagttgtcgtttccaatcaaaaaacggcgttcgatttctatcggcataagatgctccgtcaaaacggtttgaacacgaccagatacagcgcggcaaccatcagcagcacggggatttcgttgaacacgcggtaccagcggtgtgaaaaagcattgctgtaatcctgaaaacggcgcagcagcacgccgcaatacaactggtaagccaagagcatcaagcccaaacacagtttgacgtgtacccagccgctgccccaccagccggcggcaaacggtatcgccgcgccgaacacgaccgcgccgaagcccaacggcgacataaaacggtacagccgcaccgccatgcccgacagacgcacatactcgggattgccgcgcggcacatcaatcatcgccatattgacgaaaatcctcggcaggtaaaacagccctgcaaaccacgaaatgacaaaaaacaagtgaaacagcttgaaccaagaaaacatcatcgcccacaccctgccgaaaagcggtattgtacaggcaaaccgcttgggaaacgtgataaaatcaggcggataaacaaatcgaataaatccttaccgcaaaacggaggcaaaatgctcaaatccatcgaactcaattcccacatccgcaaccgccttgcagaatatctgaaaggcaggggtatggattttcagacggcaatgcaggaagaaaaaggcaacaaagaaatcgccgccatcgtccacagcggtttgcccactctggtccgcaaactgtattccgaacaaaaaatgcagaagtttttttgggaaaagcgggatttgattgccgactacatcagccgccggatgcagggataggtggctgaaatctgttttcaggcaagtgaaaagacaatatggcagattgaaattacgcttatcgtcattcccgcccgcgcgggaatccgacttgtttggtttcggttatttttcgtttcgtaacttttgagccgtcattcccgcgcaggcggtaatccggcttgttcggtttcggttctttttctcgtttcgggtgatttctaaaccgtcattcccgcgcaggcgggaatctaggtctttaaacttcggttttttccgataaatttttgccgcattaaaattctagattcccgctttcgcgggaatgacggcggagggtttttagttttcccgaaaatgcacatcatccaaaatcccgttattcccacaaaacagaaaatcaaaaacagcaacctgaaatcccgtctttcccgcgcaggcggtaatctgaacacgtccgtagtgaaacctatatcccgtcattcgcacgaaagtgggaatccaggatgcagggaaaaccgttttatccgataagtttccgcaccgaaaggtctagattcccgctttcgcgggaatgacggcggagggtttttagttttctcgataaatgcacatcatccaaagtcccgttattcccacaaaaacagaaaatcaaaaacaacaatctgaaattccgtccttcccgcctgtgcgggaatccggcttgttcggtttcggttctttttctcgtttcgggtgatttctaaaccgtcattcccgcgcaggcgggaatctaggtctttaagcttcggtttttcttgataaattcttgccgcattaaaattctagattcccgctttcgcgggaatgacggcggagggttttttgttttcccgataaatgcacatcatccaaagtcccgttattcccacaaaaacagaaaatcaaaaacagcaacctgaaatcccgtccttcccgcgcaggcggtaatctgaacacgtccgtagtgaaacctatatcccgtcattcgcacgaaagtgggaatccaggatgcagggaaaaccgttttatccgataagtttccgcaccgaaaggtctagattcccgctttcgcgggaatgacggcggagggtttttagttttctcgataaatgcacatcatccaaaatcccgttatttccacaaaacagaaaatcaaaaacagtaacctgaaatcccgtcattcccgcgcaggcgggaatccggcttgttcggtttcggttctttttcttgtttcgggtgatttctaaaccgtcattcccgcgcaggcgggaatccagacctttaaaccccgaccatccttgataaattcttgcggcattaaaattctagattcccgctttcgcgggaatgacggcggagggttttttgcttttcctgatttttcattgcgatgtagtataatgtagtatataatcattataattttaacacttgacaaaggaaaatttctcatgacactgaaagcaagcaagcaagcaagcaagcaagcaagcaagcggtcgggttaatctattaacattatctgttttatcgctgttttgcacgccatatgtttgaggttcggatgcgtacgatcccgtcaaagaagccgagattaaaaacaaatttattttagaagcggcggaagacagaaattcccacgtttggcgcggcccgtgcagcatatcttttgattgcttcggtatgttcagagctcagcttggttcaaatactcgttctaccaaaatcggcgacgatgccgatttttcattttcagacaagccgaaacccggcacttcccattatttttccagcggtaaaaccgatcaaaattcatccgaatatgggtatgacgaaatcaatatccaaggtaaaaattacaatagcggcatcctcgccgtcgataatatgcccgttgtcaaaaaatatattacagagaagtatggggctgatttaaagcaggcggttaaaagtcaattacaggatttatacaaaacaagaccggaagcttgggcagaaaataaaaaacggactgaggaggcgtatatagcacagtttggaacaaaatttagtacgctcaaacagacgatgcccgatttaattaataaattggtagaagattccgtactcactcctcatagtaatacatcacagactagtctcaacaacatcttcaataaaaaattacacgtcaaaatcgaaaacaaatcccacgtcgccggacaggtgttggaactgaccaagatgacgctgaaagattccctttgggaaccgcgccgccattccgacatccatacgctggaaacttccgataatgcccgcatccgcctgaacacgaaagatgaaaaactgaccgtccataaggattatgcgggcggcgcggatttcctgttcggctacgacgtgcgggagtcggacgaacccgccctgacctttgaagacaaagtcagcggacaatccggcgtggttttggaacgccggccggaaaatctgaaaacgctcgacgggcgcaaactgattgcggcaaaaacggcggattccggttcgtttgcgtttaaacaaaattaccggcagggactgtacgaattattgctcaagcaatgcgaaggcggattttgcttgggcgtgcagcgtttggctatccccgaggcggaagcggttttatatgcccaacaggcttatgcggcaaatactttgtttgggctgcgtgccgccgacaggggcgacgacgtgtatgccgccgatccgtcccgtcaaaaattgtggctgcgcttcatcggcggccggtcgcatcaaaatatacggggcggcgcggctgcggacgggtggcgcaaaggcgtgcaaatcggcggcgaggtgtttgtacggcaaaatgaaggcagccgactggcaatcggcgtgatgggcggcagggccggccagcacgcatcagtcaacggcaaaggcggtgcggcaggcagtgatttgtatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcattgtcggaaaaggcaataatgtgcggttttacctacaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcactcgaagggcggttcggtattgaagccggttggaaaggccatatgtccgcacgcatcggatatggcaaaaggacggacggcgacaaagaagccgcattgtcgctcaaatggctgttttgatgcgtcgggaaatgttttgacgcacaggcggtacaccggcacggcaccgcgcgccgccccgcaaaccaatccgaaccctgccgccccgaagggcggggcataatgatgaaaccggcggaaaaccgccggttttttgccgccgtttgaaacccgattctggcttcagacggcattgtcgcggcatcgggcggcagggtttggaacagcggcataaaaaactgatacaatccgccgattgataatggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccgatcgacagggagaaggtgccggggcaggtgcgggaaaaaggaaaagttttgcagattgacggcgaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgccgcccaacccgacgcgcccgccgtccgtatgcgtttggcggcagcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggcgggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctgattgctgttccttttcggaggaaaccctgccggcggcggtatcacggcgggcatcggcggctttcgggcggtgctttgcgtgccgccgcgtgtgcggaaacgcattccggtttttccggcataacggcgatgcgaggtaaaatgccgtctgaaacccgattcgggcttcagacggcattgtcgcggttgcggcgggcgggttcaccagattccgtcaaaggttttcgcgccgcgccaaaatttccacctgtcggcgggtttgaaggtcagcgtaccgccgtgttgtccgtccgtggtgatgtccagccgtttgattttgccggtgcggacggcttcgtagattggtgcgaaccagcgttcttcccactgctgcaatattgccgcataccgctccctgtcccctgtcagggcggtcaggcgcaaatcgtccataaacaggatatggtgcgtgtcgggcaggtgtgccgccgtttcttcataggcgcggaagttgtcgggtaatgcgcggcggtcggagtggaaacggctccaaaccgtatcggcgaaaagcgtgccgccttgcgcgccgccgtttgtgccgtcccaaagccataagccgttcaactcgggcagcccgcgtttcttgcggttatggttgacggggtgcgccgccagccacatttggatttcggtttggacgcgcagccattccaacgcatcttctccgtccggctgatcgtcagcgcccaacaatccgcccaagtccaaaacgggcttcgcgccccagcggtacgcgcaaggaagggaaaccagccataattcgggcaggacgggaacgaaacgccatggaatgtcgccgtaaaacgccgacaggtcgcggcagatccgttccgcttcatccgtaccgacgttcagatattccgccgttagcacatttgcctgatgcatccccatcttttgccagacgggcgtggcgagcgcgacggcttcagacggcatattcaggctttgcgccgcgcgttccaccagtctgccgcaccacaaataacgcgcgtaaaatgccgaagccgtgcagctttggcggtgcagcgagccgtattgcaggattttgttgaaagcgtgcaggcatagaggtattcggatttcgtcttcatccaaattgagcgagggaatggcgagggtgagtttcatcgtttgacgtttcagaaatgcaggtcaggcgcaacattatagaggattcggcgcaaacgccgtcaaaaaggaacaatatggctgtcttcccactttcggcaaaacatcggaaatacgcgctgcgtgcgcttgccgtttcgattattttggtgtcggcggcatacattgcttcgacagagaggacggagcgcgtcagaccgcagcgcgtggaacaaaatctgccgccgctgtcttggggcggcagcggcgttcagacggcatattgggtgcaggaggcggtgcagccgggcgactcgctggcggacgtgctggcgcgttcgggtatggcgcgggacgagattgcccgaatcacggaaaaatatggcggcgaagccgatttgcggcatttgcgtgccgaccagtcggttcatgttttggtcggcggcgacggcggcgcgcgcgaagtgcagttttttaccgacgaagacggcgagcgcaatctggtcgctttggaaaagaaaggcggcatatggcggcggtcggcttctgaggcggatatgaaggttttgccgacgctgcgttcggtcgtggtcaaaacgtcggcgcgcggttcgctggcgcgggcggaagtgcccgtcgaaatccgcgaatccttaagcgggattttcgccggccgcttcagccttgacggtttgaaggaaggcgatgccgtgcgcctgatgtacgacagcctgtatttccacgggcagcaggtggcggcgggcgatattttggcggctgaagtcgttaagggcggcacaaggcatcaggcgttctattaccgttcggacaaggaaggcggagggggcggcaattattatgatgaagacggcaaggtgttgcaggaaaaaggcggcttcaacatcgagccgctggtctatacgcgcatttcttcgccgttcggctaccgtatgcaccccatcctgcacacatggcggctgcacacgggcatcgattatgccgcaccgcagggaacgccggtcagggcttccgccgacggcgtgattacctttaaaggccggaagggcggatacggcaacgcggtgatgatacgccacgccaacggtgtggaaacgctgtacgcgcacttgagcgcgttttcgcaggcggaaggcaatgtgcgcggcggcgaggtcatcggttttgtcggttcgaccgggcgttcgaccgggccgcacctgcattacgaggcgcgcatcaacgggcagcccgtcaatcctgtttcggtcgcattgccgacaccggaattgacgcaggcggacaaggcggcgtttgccgcgcagaaacagaaggcggacgcgctgcttgcgcgcttgcgcggcataccggttaccgtgtcgcaatcggattgaagtttgaaccggcgacgaaaacaatgccgtctgaaaacctgcaaacaggttttcagacggcatttatagtggattaacaaaaatcagtacggcgttgcctcgccttagctcaaagagaacgattctctaaggtgctgaagcaccaagtgaatcggttccgtactatttgtattgtctgcggcttcgtcgtcttgtcctgatttttgttaatccactatgcagttgattaaaacaaaactaagccaaggaagcactgccgtcattcccgtacgggcgggaatcctgacaccacggcacggaaacccatccgctgtcattcccacgaaagcgggaatctagaaatacaacgcggcaggagtttatcggaaatgactgaaacccaacgtaccggattcccgctttcgcgggaatgacgaagtgggcgggaatccggatttatccgttccgacagtgtttgcaaataaaagaaaacccaaccgtcccgattcccggcagggctgttttacggattttgcagcgagggcgcggggcggtcttgcgcctgtttggtttgcagggttgtcagttttttcgtcagcagattcagtatcacgccgtaggcgggcaggaagaagagggtgcagacggtaagtttgaacaggtaatcgacaaaagcgatgccctgccagtttgccgccataaatccatcgctgcttgcgtagaaggcaacggcgaaaaataccagcgtatccaaggcgttgccgatgacggttgatgcggtcggtgcaatccaccacgctttcagacggcgtaatttgttgaatacaaaaatatcaaggatttgtccgatcgcgtaggcggcaaagctggctaaggcgatgcgtccgacaaaggtgttgaattcggacagcgcgcccaagcctgtccaactgccgttgtggaacaaaacggaaaagacgtaggaaagcaaaagggcggggaacatcacccaaaagataatccgccgtgccaagtgagaaccgaaaatgcggacggtcaggtcggtggcaaggaagatgaagggaaaggaaaatgcgccccaagtggtgtggatgccgaaaatttggaaagggaactgcaccagatagttgctggcggcgatgatgaggatatgaaaaagcaccagccggaagagtgccttctgttgctgtgcggcggtaaatgcgtacataaaaatctttcggaaaggcgttcagacggcatatcgtatcgaaggaatgccgtctgaaatatgggaaggatggtttattgtgcgtcgtgctcaaacaagcgtttgcgtgccaatgtttcgaactcggtgcctgcttttccgtagttggcaaacggatgaatggcgatgccgccgcgcggtgtgaactcgccgaatacttcgatgtatttcggatccatcagggcaatgaggtctttcatgatgatgttgacgcagtcttcatgaaaatcgccgtggttgcggaagctgaagaggtagagtttcagggatttgctttccaccattttgatgtgcggaatgtagcggatgtagatggtggcgaagtcgggctgcccggtcatggggcagaggctggtgaactcgggacagacgaatttgacgaaatagtcgttgtcgggatgtttgttgtcgaatgcttcgagaatttcaggcgcgtagccggtcggatattgggttttttgattgcccaaaagagagatgccttgcagctcttcgttgttgcgggacatgagggtttccttagttttttaatgtgggaggttttcgaaccacgggcggcgattgtaatataagcggcggtatctgtgtagttttcttcagacggcatggtttggacggcggcgttttccgtgtcatatatagtggattaacaaaaaccagtacggcgttgcctcgccttagctcaaagagaacgattctctaaggtgctgaagcaccaagtgaatcggttccgtactatttgtactgtctgcggcttcgccgccttgtcctgatttttgttaatccattatataaacgaaatatattttcagttttgccgcctgaagcgttgttttttgaatattgcatctaaaatactgacttgattgcgttattgcgcggatatagaatctgcttcctattgaaagaacattgtttatatgaaatcaggaaattcggaacccaatcttatggatacgcacacggacgaaacaaaacttcaaaacacgcaagccaaacgcaaacgccgcctgacggcattgacgctgctgttcgcgcttgccgccgcagccgccgggtcggcgttttttttatggtggcagcacgaagaggaaacggaagacgcttatgttgccggacgcgtggttcaggttacgccgcaaaagggcggtacggtgcggaaggttttgcacgacgatacggatgccgtgaaaaaaggcgacgtgctggcggtattggacgacgataatgatgtgctggcttacgagcgggcaaaaaacgagctggttcaggcggtgcggcaaaaccgccggcaaaatgccgccacttcgcaggcgggggcgcaggttgccttgcgccgggcggatttggcacgcgcacaggatgatttgcgccgccggtctgctttggcggaatcgggcgcggtgtccgccgaagagctggcacacgcccgtgcggcagtgtctcaggcgcaggcggcggtcaaagcggctttggcggaagaatcttcggcacgtgcggctttgggcggtcaggtttctttgcgcgaacagccggcggttcagacggcaatcggcaggttgaaagatgcgtggttgaaccttcagcggacgcaaatccgcgcgccggcggacggtcaggtggcgaagcgttcggtgcaggtcgggcagcaggtggcggcaggcgcgccgctgatggcggtggtgccgctgtcggatgtgtgggtggatgctaattttaaagagacgcagttgcggcatatgaaaatcggacagcctgccgagctggtgtccgatttgtacggcaaacaaattgtttatcgcggcagggtggcaggtttttcggcaggtacgggcagcgcgttttcgctgattccggcgcaaaacgcaacgggcaactggattaaagtggtgcagcgcgtccccgtccgtatcgtgctgaaccgcgaagatgtggacaggcatccgttgcgtatcggtttgtcgatgacggttaaagtggatacttccgccgcaggcgcgcctgtttcaaaaacgccgggtgcggcattgccggaaatggaaagtaccgactggtcggaagtcgatcggacggtcgatgaaatcctcgggcaatccgcgccctgatgccgtctgaaacggaggacacaatggattatccaccgcttaagggtgcggcattggcgtgggttacgctgtctttggggcttgccgtatttatggaagttttagatacgactatcgccaatgtcgccgttcccgtcatcgccggcaacctcggtgcggcaaccactcaggggacgtgggtcatcacttccttttctgtggcaaacgccgtttccgtgccgctgacgggctttttggcaaaacgcatcggcgaggtcaaattgtttaccgccgccgctgtcggtttcgtcatcacatcgtggctgtgcggtattgcccccaaccttcagtcgctggttgttttccgcatcttgcagggctttatcgccgggccgctgattcccttgtcgcaaagcctgttaatggcatcctatccgcccgcaaaacggacgctggcactggcattgtgggcaatgaccgtcgttgtcgcccctgttctcgggccgatactcggcggctggatttccggaaactggcattggggttggattttcttcattaatatccctatcggtatcatatcggcatggattacatggaaacatttgaaatatcgggaaacggaaaccgttaaaatgccgaccgactatgtcgggcttacattgatggtagtcggtatcggcgcgttacagatgatgctggacaggggtaaggaactcgactggttcgcctctggagaaatcattaccttgggcgtagtcgcactggtgtgcttgtcgtattttattgtttgggaattgggagaaaaatatccgattgtcgatttatcgctgtttaaagatcggaattttaccgtcggcgtcattgccacgtcattgggttttatggtgtatatggggacgctgaccctgctgccgttagtgttgcagaccaacctgggctatacctccacgtgggcagggcttgccgccgcacctgtcggcatcctgcctgttttcctgtctccgttaatcggcaggttcggcaataaaatcgatatgcgcctgttcgtaactgccagcttcctgacctttgcctttactttctattggcgtacggatttttatgccgatatggatattggcaacgtcatctggccgcagttttggcagggtgtcggtgtcgccatgttttttctgccgctgaccaccatcacactgtcgcatatgaagggcgggcagattgccgccgcaggcagcctgtcgaatttcttgcgcgtgctgatgggcggtgtcggcgtatccgtcgtcagcaccctgtgggaacggcgcgaagcgttgcaccacacacgctttgccgaacacatcacgccctattccgcaacattgcacgaaacggccgctcatttgtcccagcacggcgtttccgacattcaaaccctaggcatcatcaacaataccattacccagcagggttttattatcggctcgaacgaaatctttatggcgggcagcttgttattcattatcatgatacccgtcatatggctggcaaaaccgccgttccacaacggcggcggcggtggacattgagggatttgaaaacttgaaatgccgtctgaaaatactggaaatatgttcggacggcattttgaatgcagcagttcccgaaatccgctataatcgcgccccatctgtttcgcacctgcaaacgttccacagatgcgacaatcggaaggattatccgcgcaaaacagccgtttttcgtttaaaacacttgaactaacactgtttttcgtggtataaatcgcgttttactattttagaagtttggagactgattatggcacgagtttgcaaagtgaccggcaaacgcccgatgtccggcaacaacgtatcgcacgccaacaacaaaaccaaacgccgttttttgcccaacttgcaatcacgtcgtttttgggtagaaagtgaaaaccgctgggttcgcctgcgcgtttccaacgctgcactgcgtaccatcgacaaagtaggcattgatgtcgtattggctgatttgcgtgctcgcggcgaagcttaatttaaacactatttaattaaggattactgcaatgcgcgataaaatcaaactggaatccagtgcaggtactggtcacttctacaccactaccaaaaacaaacgcactatgcccggcaaattggaaatcaaaaaatttgacccagttgcccgcaaacacgtagtgtataaagaaactaaactgaaataatttcagtttgaaagcaaagcctccgactgctcggaggctttgttatttttatcgtgtttcctttccgcttgaaacatctgccgtatgcgaatctgctgcaaaccgtctgccaaggatatgaaaaccgcaaaacggttcataacacaaaaatgccgtctgaaacgtttcagacggcatttcggcagttttcaaccggtcagttgtttggtgatcagtttcttcagcggtgggaaattgttgctggcacgcaataccaagccgcgcaacagttttgccggtgcggtctcattggtaaacagtttcagcatcatattggttccgtgataaagcggatgggcgtgcagcatatgtttgctgctgtatttttccaataatgaagatgcaccgatgtcttgaccgcgctgttcggcttcgagtatcagttttgccaaaatatctgcgctggaaagccccaagttgaaaccgtgtgctgtaacggggtgcataccgacggcggcatcgccaatcagcgcgctgcgtttgccgtagaaacgtttggcaatcatgccgacaagggggtaatggtggatgctgctgaccaattccatatcgccgagcctgcccttgagctgttcttttacgcttgccgccaattcttcgggcgaaaggttttgaacgctgttgattttatcggtatcgacggtaatgacggtattggtcaggtgctcttccagcggcagcagtgcgatggtgcgtccgtaatggaagcattcgtaagcggtatgttggttggaaagggtatgtttcatacggcagacgaacatggttcggctgtaatcgtgcatatcggaggagataccgagttgtcgacgggtttgcgagaagcggctgtctgccgccaaaagcaggcgtgcagtcagtattttgccgttttccaaaatgacttgtgcttcgttgtcagatgttttgacttctttgacaaccgtatcggtcagaatgctgacattgtcgagttgtgatacgacttcataggcggcgcggcggatattgtggttggaaatcagatagcccaaacagtcggcaggttcgccgcgcgcttcagtcggttggggaaagtggagctggtagtcggaacgtccgttcagcactttggcatcgcgcaaagggtagatttcgttttcgggaattttgtcccacatacccaaacgctgcatgatttcgcgggaaaaatgggtcagggcgatttcgcgtccgtcatatggaggattttgcagaacagtcagtgggctgcgttcgatcagggtaactttcaaaccgctgccggcaagttcggctgcaaaacttaaacccgccgggcctgcgccgacgacgaggatgtcgctgtgtaaactcataaaatatcctttgcatagacggatgccgatgatttcagatggtatttg

SEQ ID NO: 37836 - DNA, 8183 bp, Neisseria meningitidis;
ccggttcgagtagtcagttaatagtttctcctctatttctcctttgtagacttggcacacattcaactggatgtgtgcatttttttatctgaagcaacaagcctctgtgcgtgatgttgttatgtttcatttaggtgtcaaaccgcatatccggtctgaaatattcaatccaaatccaaaaccggattttctttgacctcctccatcacaacataactcctactctccgaagcggcaggcagttgcaataggatattgcctagcatatcccgataggcagacatatcgggcaaacgtactttaatcagatagtcgtattcgcccgacaccaagtggcattccataatttgcggaattttcagcacttcttttttgaaatcttcgaaaatattgcccgatttggattgcagcttcagctcgacaaaaaccaataaaggtttgcccaacagatggggattgagatgggcgtgataaccggaaatataatgttcccgctccaaacggcgcaccctctctgtaacgggcgtggtggacaagcctaccttctcggcaagctccgtcatcgggatgcgggcattctgttgaaggatcttaaggatgcggaaatcgattttatctagttctttcatttagattgccttgtatttattattgattttaacaaatagagtatatagtggattaacaaaaaccagtacggcgttgcctcgccttgccgtactatttgtactgtctgcggcttcgtcgccttgtcctgatttttgttaatccactatatatttgagaaagcgattatatcaggaaaagcaaaccgccttcctacctgaaaactgctgcttcggcttgaagacacaaggttctttaatattttaaaagccttgccgttggattataatcccccaaccgatttcttaattttgctaataaacacttgcttggtaaggaatgaatttatgcgccctttgaacgtgcagatcaggttgggcaaccttaggcacaattatcggattttgaaggaaatgcacggaggcaaactgttggcggtagtgaaggccgacgcatacggacacggtgcggtcagatgtgctttcgcgctggcagacttggcagacggctttgccgtggcgacaatcgatgaaggaatcaggctgcgggagagcggcattacccatccgattgtccttttggaaggcgtatttgaagcatcggaatacgaagcggtcgaacaatactcgctttggccggcagtcggaaaccaatggcagcttgaggctttgctgatccgccattggaaaaaaaccgtcaaagtctggttgaaaatggattcggggatgcaccgtaccggttttttccctcatgattacgcttcggcatatgcggcattgaagcagtcggaatatgtggacagtattgtcaaattctcgcatttctcctgtgcggacgaacccgaaagcggtatgacggaaatacagatggaagcattcgatttgggtacggaagggctggaaggcgaagaaagccttgccaactccgccgctattttgaatgttcccgaagcacgcagggactgggggcgcgccggtctggcgttatacggcatttccccgttcggaggaggcgatgacaggctgaagcccgtgatgaggctttcaacccgtattttcggcgaacgcgttttacagccgcactcccctatcggttatggcgcaacattttataccagcaaatctacgcgcgtcggcctgattgcctgcggttatgcggacggttatccgcgccgcgccccaagcaattcccccgtcgctgtcgacggcaaattgacccgggtcatcggcagggtctctatggatatgatgaccatcgagctggatgcttcgcaagaaggtttgggacacgaggtcgaactgtggggcgatacggtcaacatcaataccgttgccgaagcggccggaaccatcccttacgaattgatgtgcaatatcaaacgtgcaaaattcacttatatcgagtaatcaagtccaaacgaaaatgccgtctgaagcctttcagacggcatttccccatcaaaaccgcaatcagtttttcatcgattgaaccggagccggaattctgccgcctcggttgacgaatacttcgcacgaaccttctttgaccggcatcacaggcgcgtagcccaacaagccgccgaactcgacgctgtcgccgacggttttaccggttaccggaataatgcgcacggcagtggttttgctgttgatcatgccgatggcggcttcgtcggcaatgatgccggaaatggtgtgcgcgggcgtgtcgccgggaacggcaatcatatccaagccgaccgaacaaacggcggtcatggcttcgagtttgtccagcgtcagcacgcctgcttcggcggcggcaatcataccttcgtcttcggaaacggggataaacgcgccactcaaacccccgaccgcgctggaagccatcatgccgccttttttcacggcatcgttcagcaatgccaaagctgctgttgtgccgtgcgtaccgcagacgctcaagcccatttcttcaagaatgcgtgccactgagtcgccgacggcgggggtcggcgccagcgacaagtcgagaataccaaacgggatattcagcatttttgaggcttcgcggccgatgagttcgcccacgcgggtaattttgaaagcagttttcttcactacttccgcaacttcggtcaatgtcgttgcatctgaattttccaacgcggcttttacgacacctgggccggatacgccgacattgataacggcatccgcttcgcccgaaccatgaaacgcgcccgccataaacgggttgtcttccaccgcgttgcagaacacgacaattttagcgcagccgaaaccttcgggcgtgatttccgccgtgcgtttgacggtttcgcccgccagcttgaccgcatccatattgataccggcacgcgtactgccgatattgatggagctgcacacaatatcggtagtcttcatcgcttcgggaatggagcggattaacacctcatccgaaggcgacatccctttttgcaccaacgcggaaaaaccgccgataaaagacacaccgatggctttggcagctttatccaaagtttgcgccacgctgacgtaagaatcagcatgggtggccgccgcgatttgggcaatcggcgtaacggaaatgcgctgattcacaatcggtacgccgtatttggcagacagatattttgccgtagtgaccaagtctttgccgactgtggtaattttattgtaaatattttggttcaacacattgatatcgctgctgatgcagtcgtgcaaatcaatgccgatggtaatggtgcggacatcaaaattctggtcggcaaccattttgacggtttctaaaatttcgccggattggatactcatcacattcctccaactcaaatgcggtgcatcgcttggaagatttcttcgttttgcatacggatatcaagcgcgagttttttgctctcttccgcaaacaaatccaaaacctcttgacgcgatttgctgcattttgaagtgtccaccaagataatcatagtaaaaaaatcgtccatcagctgttggctgatgttgagaatattgatttggttttccgccaaaattttggaaacatcgtacacgatgccgacgcggtctttaccgatgacggtgatgactgaattgttcacaggcttactccttgcagatatccgttaaagtccgaaattataccaccgttggattttgaagaaatattgtcaacaatatatacatacaaaatgccgtctgaaactatttcagacagcatcaagattcagggttcgattaaataaccatccttatcccactgggttttcctgaccaacttgtcatcctgataaacagcttcgctctttttagaaccatcttcataccactccaaaaccaccccgttgcgttgatggtggcggatagacagttccgagagtaatcggccgctttcatcccaagtcagaattttggcaggctcatcgttgaccataaccatttccgtcttgatactgccgtcggcataccattgcttccatacgccgtttgccttattttgcttaaactggatttcgctttccttgccgccgttacggtaatagcggtatcccgtaccctcactcaagccatttttataaggcataacggcagattttttaccgttcggataccagttgacccactccccgtccggcttacccttgctgaagccccccgccatttttttctgaccattaaaatgccacaaaatcaacataccgttttgcagggtaggcacaaaagatttgatttgcgttgaagcaacgatataaggttcagaatatttcttcatcgacggataataaaaatcctgcgcgtgcgcaatacccgccaccacactatattgcctgatataagcggcagaagacatcgtcgccgtcagctttccgttctgattaaaataaacagaataggtctgcgccggcaaagcggccgaaaaacccaacaggacagttgaaaatacaatccgagataattttttcattgcaatagcgatataaaaacaaggctgtgttttagtaatctgttgatttcaattatttgcaagggaaaagacaattattttccggttaggaataaacctattctattgaatatattgaagccaagtacgcctatcaacactatattaaaacactgccaaaaacaattaacttataaacaatatggtaaggatttctctgccaagcatcaaacccgagacaacgtatcgtaaaaatgccgtctgaaaacaaatcgtcttcagacggcatttccccttcaactcactcttcacccaataactgctcgcgcgtcaagaggaaaacaaaaccgtcgcccccgctggtttccaaccaagtaaaaggcaactccggatacgctgcttccaatacatccctgttatgcccgatttccaccagcaatacacctttgggattcagaaactttgccgcattcagaagaatctgcctggtggcatccaacccgtccgccccgctgcccaatgccaattccggttcgtgcaaatactcttcaggcaataactcaaccgattccgcatccacataaggaggattggaaacaatcaaatcataagtgccttccaatccttcaaacaaatccgtatgaataagccggatgcgttcttccaaaccataatcttcgacattaatccctgccacttccaaagcatccaagctcacatcaaccgcatcaatttgggcatcaggataatgatgcgccatctgaatggcaaggcaaccgcttccggtgcaaagatccaaagcattatgcaccaactcatcgtattctatccaaggacgaagtccgtcacccaacaattcataaataaaagaacgaggtatgattacgcgctcatccacatagaaatcaaactctccctgccatgcctggtgtgtcaaataagcggctggaatgtgttcgacagcacgacgctcaataaccgccagcacttcctctttttcagcttccaagagttttgcatcaagatatggggcaagcatatccaaaggcaaattcaaagtatgcagaatcaaataagctgcttcatcatgcgcattatctgttccatgaccaaaaaagagccctgcctcattaaaacggctgactgcaaaacgtaaaatatcgcggatagtcgtcaattcttgtgctgcctgattaaacataatatgaaccattctgcgtatagatacttttaattataacagaaacaacaagcaaaccttttcatatcgccaaataaccacccaatctacccatacaactacataaatgcccgcgcgaaaaccatcgcccgaacggaaacgacaatggccgacggtatgggcaatctgattggctgggaaaaaacggggcttgttgtcggtaagcagtggataaccgcaaaagacgacaaggtgtccgatgtctgcaatgccaacggcgagatgggcgtaatcgggctttacgagcctttctcacacggcgcattgacgatacccggtcatccgaactgccgatgcgaggttgtttccgtatcgggtggcgaattgggggaatttgccgaaaaaaaggagcttcgtaaagcggctatgcagtatgcgcgggataactttatcggcaaaagctatgtcaataaaaacagcgggcatgaactgaaggtaacttggcaaggtgtgaaacacgctgcgtcaaaggcaaatcaggcggaattatccatcatgacaaaacttgatgacttattgcgctacgcaaaatatgagggttcttattcggataggaaaggtcatcctaatattattgcagcacataagtatcgtgccgttgccaaggttgggaatgagtctttaaatatcggtgtgattgtaagggaatttccagacgaccataaacattacgaccatttcatcttgaaggatgaataaagcccttttgcagtgtcgttctggagcggatagcgttaaggcaagtacacttccagccttgaaaaagggctttaaattcagcatgccatttatacaggcaggagtaaacccatgacaaagttatacgcagaaatcgccaagatggagacgcaggacgacgacacggtcaaggtttggggttacgcttcaagcgaggaaatcgattcggacggcgaagtcatcgcggcggcagctatgaaggcggcgattcccgattatatgaagtttggcgcggggcgcgagatgcacggctcaaacgctgcgggaacggcaattgaaatcaacgtggaagatgacggcagaacctttttcgtggcgcatatcgtcgatcccgttgccgtgacgaaggtcaaaacaggcgtttacaagggcttttccatcggcggcagcgttaccgcccacgatgagttgaacaagtcgcaaatcacgggtttgaagctgacggaaatcagcttggttgaccgacccgccaatcccgatgcggtgtctacctgctttaaggcggacaaaggtgcggaagcggtaaacaacgatacagaacataatgctacatattttagccatttcccttccaaacaaaaaagcaccgacggcggccgatgccctttcctttacaggttcccctattttttatccgcgggcagcaccggtttggctggggcttttggtgcgggcgcgccgaccgaagcctggtccttcagcttcgccagcaccgcagggccgatgccctttaccttggtcaaatcgtctacagacttgaacgcaccgttttgcgcacggtattccgcaatggccttcgccttcgccgggcctatgcccggcagcgcctccaactcctgctgcgaagccgcattgatgtttaccgccgcaagggagaaggcgcaggagaacagcatacagaacagcacgaacattttcttcatggtttttcctttaagggttgcaaacaataaaccgcatcttgcgacgataaaacgagtcattctaaaatgaatatcccaaagtttcaagccgttcctccgcaaacccgaccggacaccgtacggatgccgtcccgccatcaccgacattttttccgggcaaagcaaacattttttccgggcaaagcaaaaacccccgaataatcgggggttttctgaatgggtgtttggcagtgacctactttcgcatggaagaaccacactatcatcggcgctgagtcgtttcacggtcctgttcgggatgggaaggcgtgggaccaactcgctatggccgccaaacttaaactgttacaaatcggtaaagccttaatcaatatattcggtaatgactgaatcagtcagtaagcttttatctcttgaagttcttcaaatgatagagtcaagcctcacgagcaattagtatgggttagcttcacgcgttaccgcgcttccacaccccacctatcaacgtcctggtctcgaacgactctttagtgcggttaaaccgcaagggaagtctcatcttcaggcgagtttcgcgcttagatgctttcagcgcttatctcttccgaacttagctacccggctatgcaactggcgttacaaccggtacaccagaggttcgtccactccggtcctctcgtactaagagcagccccgtcaaacttccaacgccactgcagata

SEQ ID NO: 37837 - DNA, 4688 bp, Neisseria meningitidis
taaatgggactataagcaggaaggcttaaccagagccggtgcagcgattgttaccataatcgtaaccgcactgacttatggatacggcgcaaccgcagcgggcggtgtagccgcttcaggaagtagtacagccgcagctgccggaacagccgccacaacgacagcagcagctactaccgtttctacagcgactgccatgcaaaccgctgctttagcctccttgtatagccaagcagctgtatccatcatcaataataaaggtgatgtcggcaaagcgttgaaagatctcggcaccagtgatacggtcaagcagattgtcacttctgccctgacggcgggtgcattaaatcagatgggcgcagatattgcccaattgaacagcaagktaagaaccgaactgttcagcagtacgggcaatcaaactattgccaaccttggaggcagactggctaccaatctcagtaatgcaggtatctcagctggtatcaataccgccgtcaacggcggcagcctgaaagacaacttaggcaatgccgcattaggagcattggttaatagcttccaaggagaagccgccagcaaaatcaaaacaaccttcagcgacgattatgttgccaaacagttcgcccacgctttggctgggtgtgttagcggattggtacaaggaaaatgtaaagacggggcaattggcgcagcagttggggaaatcgtagccgactccatgcttggcggcagaaaccctgctacactcagcgatgcggaaaagcataaggttatcagttactcgaagattattgccggcagcgtggcggcactcaacggcggcgatgtgaatactgcggcgaatgcggctgaggtggcggtagtgaataatgctttgaattttgacagtacccctaccaatgcgaaaaagcatcaaccgcagaagcccgacaaaaccgcactggaaaaaattatccaaggtattatgcctgcacatgcagcaggtgcgatgactaatccgcaggataaggatgctgccatttggataagcaatatccgtaatggcatcacaggcccgattgtgattaccagctatggggtttatgctgcaggttggacagctccgctgatcggtacagcgggtaaattagctatcagcacctgcatggctaatccttctggttgtactgtcatggtcactcaggctgccgaagcgggcgcgggaatcgccacgggtgcggtaacggtaggcaacgcttgggaagcgcctgtgggggcgttgtcgaaagcgaaggcggctaagcaagctgctcctaaagaaacaataaacaatttggcaaatttagccaaagcagaacagcagattttattccgtattgcccaacgcgatacgcaactggatgcatggaagacgggatttaacaatagagtaaggaaaggagcaggcttgcttgatgcaagtaatattccgataaccattaacggaaaaaccatcaaacctgtacaagccataagcttaaagggagcacccgtttacagcggcgtaagcgaacaggagatttttgcgctttatcggcagatgactggccagaatccgaattttagagttttgcctgacggaagattagcaaatggcattatcagtactggagaatgggcaggaacaaaaattgcattaagaaatttttcaaaaacagagaattcaactcaagcacgatggacattagatttgcagaatcctccatcatttattaaaggtactaaattggagcttaaattccaataatttacaaaggattttaccgtggatgagaaacaaaaaattaagattcttgattttcaaatcgatttatcctcaatttttaactcttataaaaatcaaatgggtattaatattcaagatgaaaacttaaaaaacaatttctgttcttttatggaagaactgttaaatgacggttcaatccgtttacatgattataccgacggtatcggaattcctctaactggaacttcaaaagaacaagtgcagaaattgaaagacatatggcctactttggaagatgcccaagcaatatggcctgaagacccttggtattacttagaatggctttggtgggatattgcgtgtccaatagatttggccgatttgccgaatattgatatttatgagcaagcgtaggtatggttagccgcctttagcggcgtaaccgtacgcatatcagcaaactttataaaataacaaggccgtctgaaatctgtttttcaactttttcagacggccttgcaacttggcatttcattcgtacggttacgcgctaaaggcggctaaccgtacctacgagctctgataaaaatgatttatggaagcaagctgtagcctgcatgaaacctaaaatccatgcgtaaggtgtgtgcttcagcgcgcacgcgttccatgatttacggctcaatgccgtctgaaaagctcacaatttttcagacggcatttgttatgcaagtaaatattcagattctctgtatactgttcagacgcgtgcgtgctgaagacacctcctacgcttgctgcagaactttcgggtaaaaccggtgtgagcattagcgcgccgtatgccaatgaaaacagccgcatcctgctgagcaccacggatatcagttcggaaaacggcaaaatcaaactgcaatcctacggcgaccagttctactacgccggacagggtgagctctacaccttcgataaacgcagctataaaaccggtaagtggtacaaactaaaacatgttactgaaatcaaagagcataaaaacgccaaagccgacccggtgagcctcagtgcgtcacaaggtattgaaatcaaatccggcggcaatatcggtgcccacgccaccttgtttgatgcaccccgcggctccgttaaaatcgaagccggacgtgggctggttctctatgccgtggaagatctcaactacgacaaacttgacacccgtaccaagcgcaaatttatcggcattacctacgacaaggtgcacgacaccaccacccacaccatgaaaaccgccctgccctcaagggtagttgcagaatcggccaacctgcaatcaggctgggacgccaaactgcaaggcacccagtttgaaaccacgctgggcggcgcagccatccgtgcaggtgtaggcgatcaggcacgagcagatgccaagattattcttgaaggcatcaaaagtagtgtgcgcactgaaacagtaagcagtagcaaatctgccctctggcagaaacaggccggacgcggcagcaatatcgaaaccttgcaactgccaagtttcacaggctccgttgcgcccgtactctctgctcccggcggctacattgtcgacatccccaaaggcaatctgaaaaccgaaatcgaaaagctggccaaacagcccgagtatgcctatctgaaacagctccaagtagcgaaaaacgtcaactggaaccaggtgcaactggcttacgataaatgggactataagcaggaaggcttaaccagagccggtgcagcgattatcgcgctggctgttaccgtggttactgcgggcgcgggagtcggagccgcactaggcttaaacggcgcagccgcagcagcggccgatgccgcctttgcctcactcgcttctcaggcttccgtatcgctcatcaacaataaaggcgatgtcggcaaaaccctgaaggaactgggcagaagccgcacggtaaaaaatctggttgtagcggcggcaacggcaggcgtatccaacaaactcggtgcctcttcccttgccacttggagcgaaaccccttgggtaaacaacctcaacgttaacctggccaatgcgggcagtgccgcgctgatcaacaccgctgttaacggcggcagcctgaaagacaatctggaggcaaatatcctggcggcattggtgaataccgcgcatggggaggcggcgagtaagatcaaaggactggatcagcactatgtcgcccacaaaatcgctcatgccgtagcgggctgtgcggctgcagcggcgaataagggcaaatgtcaggacggcgcgatcggtgcggctgtgggtgagattgtcggggaggctttggttaaaaataccgattttagcgatatgaccccggaacaattagatctggaagttaagaaaattaccgcctatgccaaacttgcggcaggtacagttgcaggcgtaacgggaggagatgtcaatactgctgcacaaaccgcacaaaacgcggtagaaaataatgcggttaaagctgttgtaactgctgcaaaagtggtttataaggtagccagaaaaggattaaaaaacgggaaaatcaacgttagagatttaaaacagacgttgaaagacgaaggttataatttagccgacaacctgaccaccttattcgacgaaacattggattggaacgatgccaaagccgttattgatattgtcgtcggaacagagctgaatcgcgctaataaaggggaagcggcacaaaaggtcaaggaagttttagaaaaaaatcgtccttatatccctaataaaggtgctgtaccgaatatgagtacatacatgaaaaataatccttttggaaaacagctggctcaaatttcagaaaagacaacgcttccgacgcagcaagggcagtctgtcttcttggtaaaaagaaaccaagggttattaaaaagccgggta

SEQ ID NO: 37838 - DNA, 15449 bp, Neisseria meningitidis
gatgatgacgaaatttacagactgtacgcggtcaaaccgtattcagccgccaacccacaggggatacatcttgaaaaacaacagacaaatcaaactgattgccgcctccgtcgcagttgccgcatcctttcaggcacatgctggactgggcggactgaatatccagtccaaccttgacgaacccttttccggcagcattaccgtaaccggcgaagaagccaaagccctgctaggcggcggcagcgttaccgtttccgaaaaaggcctgaccgccaaagtccacaagttgggcgacaaagccgtcattgccgtttcttccgaacaggcagtccgcgatcccgtcctggtgttccgcatcggcgcaggcgcacaggtacgcgaatacaccgccatcctcgatcctgtcggctactcgcccaaaaccaaatctgcactttcagacggcaagacacaccgcaaaaccgctccgacagcagagtcccaagaaaatcaaaacgccaaagccctccgcaaaaccgataaaaaagacagcgcgaacgcagccgtcaaaccggcatacaacggcaaaacccataccgtccgcaaaggcgaaacggtcaaacagattgccgccgccatccgcccgaaacacctgacgctcgaacaggttgccgatgcgctgctgaaggcaaacccaaatgtttccgcacacggcagactgcgtgcgggcagcgtgcttcacattccgaatctgaacaggatcaaagcggaacaacccaaaccgcaaacggcgaaacccaaagccgaaaccgcatccatgccgtccgaaccgtccaaacaggcaacggtagagaaaccggttgaaaaacctgaagcaaaagttgccgcgcccgaagcaaaagcggaaaaaccggccgttcgacccgaacctgtacccgctgcaaatactgccgcatcggaaaccgctgccgaatccgccccccaagaagccgccgcttctgccatcgacacgccgaccgacgaaaccggtaacgccgtttccgaacctgtcgaacaggtttctgccgaagaagaaaccgaaagcggactgtttgacggtctgttcggcggttcgtacaccttgctgcttgccggcggaggcgcggcattaatcgccctgctgctgcttttgcgccttgcccaatccaaacgcgcgcgccgtaccgaagaatccgtccctgaggaagagcctgaccttgacgacgcggcagacgacggcatagaaatcacctttgccgaagtcgaaactccggcaacgcccgaacccgctccgaaaaacgatgtaaacgacacacttgccttagatggggaatctgaagaagagttatcggcaaaacaaacgttcgatgtcgaaaccgatacgccttccaaccgcatcgacttggatttcgacagcctggcagccgcgcaaaacggcattttatccggcgcacttacgcaggatgaagaaacccaaaaacgcgcggatgccgattggaacgccatcgaatccacagacagcgtgtacgagcccgagaccttcaacccgtacaaccctgtcgaaatcgtcatcgacacgcccgaaccggaatctgtcgcccaaactgccgaaaacaaaccggaaaccgtcgataccgatttctccgacaacctgccctcaaacaaccatatcggcacagaagaaacagcttccgcaaaacctgcctcaccctccggactggcaggcttcctgaaggcttcctcgcccgaaaccatcttggaaaaaacagttgccgaagtccaaacaccggaagagttgcacgatttcctgaaagtgtacgaaaccgatgccgtcgcggaaactgcgcctgaaacgcccgatttcaacgccgccgcagacgatttgtccgcattgcttcaacctgccgaagcaccgtccgttgaggaaaatataacggaaaccgttgccgaaacacccgacttcaacgccaccgcagacgatttgtccgcattacttcaaccttctaaagtacctgccgttgaggaaaatgcagcggaaaccgttgccgatgatttgtccgcactgttgcaacctgctgaagcaccggccgttgaggaaaatgtaacggaaaccgttgccgaaacacccgatttcaacgccaccgcagacgatttgtccgcattacttcaaccttctgaagcacctgccgttgaggaaaatgcagcggaaaccgttgccgatgatttgtccgcactgttgcaacctgctgaagcaccggccgttgaggaaaatgcagcggaaatcactttggaaacgcctgattccaacacctctgaggcagacgctttgcccgacttcctgaaagacggcgaggaggaaacggtagattggagcatctacctctcggaagaaaatatcccaaataatgcagataccagtttcccttcggaatctgtaggttctgacgcgccttccgaagcgaaatacgaccttgccgaaatgtatctcgaaatcggcgaccgcgatgccgctgccgagacagtgcagaaattgctggaagaagcggaaggcgacgtactcaaacgtgcccaagcattggcgcaggaattgggtatttgattcccaactgccctttcgcagatcaaggatgccgtttcagacggcatcttttttgccttatcggtgtaacggataaagtttgaaccggcacaggctcaaacagcaggtcgacggcaacaaaatgccgtctgaaacccctaaaggcttcagacggcattggcggcggcggtatcaggcagtttgataggcaaccgaatcgtcgccgcttttcttttgaatgaactcgattttgtatccgtcggggtcttcgacgaaggctatcacggttgtgccgtgtttcatcgggccggcttcgcggacgacgtttccgccctgccgcttcacacgttcgcaggcttcgtaggcatcgtccacttcaaccgcgatgtgtccgtaggcgttgcccaagtcgtatcgttccgtatcccagttgtgcgtcagttccaaaaccgtgctgtcggtttcatcgccgtaaccgacgaaggcaagggtaaatctgccttcgggataatcttttcggcggagcagtttcatacccaaaacgttttggtagaaatcgagggattttcgagattgcccacgcggagcatagtatggagtaagcgcattttttgtgttcctttcggtggtggttaaacttcgattttattcggggtaaacgtctgccatttgttgcaggcggggcagtgccagaaaaagacttgggatttgaagtggcagttgcggcaacggtacatcacgctgcgctgtagctgccgtccgataaccgaacgcatcatgtcggcatcggctttccaagccggattcatatcgctgagtttcaaaccgagcaggcggtacacgccgttaaggtcgggcttgcggcggacaagctcgacggcggtttgcgcggcttctttctcgcacttaagcagcagggatttctcgtacacgacattgatcaggtcaagttcgggaaacgtctgcatatatcctgtcagacggttcaagccttcttcaggttttccctgcgcggcataggcttcgtaaagcttctcgccgaccatgctcaagtatgcatggttttgctgctcgatggcggcataggcttcgacggcggcagggaaattgccttgtcggtgttcgatgtcgcccaaaatcatgttggcgcgggtgcattttttgttggcttcgagtgccttgccgacattgaaacgcgcgacatcgaaattggacttgaacagcgcggcttgggcaagttcgcaataaaactgggcgatttcaaactgataggtctgatcgtcatggctgagcagccgggcggtttcaaccgctttttcccaatccctgtcctgttggtagatattgagcaggtgctgtctggcttcacgcgccattttaccgtcttgcagccccaaaaaaatctgttcggcacgatcgaccaaccccgcactttggtagttttgcgccaattcaaacaggacgcgcgcgcgcttttcgccgaccgtatcgggagaatcgagcattgtccggtgtatgttgatggctttgtcgttttcgccacgctggcggtaaagtttgccgagggtgaggttcaaatcatacgattgcggccggccgtcgacgacttccgccaactcccttgccgcgcgcccgctgttgcggtcgaccaaagcgtccaagcttttataaaatcccgaagggatgctttttgcctgcttcaatacggttttcatatccacgcgggcggcaaaccagcccatcgcgaagaagacgggcaaaaggataatcggcagcaggataatccacaattcgttgtccatatcggctttcttaaggctgtttggtagattcgggcgcattttgcgccggtggtgcggtcagctccttccccgtcaaacgcgcatttttctttacttcggcacgcaacctgccgttctcgccacgtaacgacaacaaccgtccgaacaaggcaaacattccaaaaataataccgactacaaatgcgccgaacaatacgacaatcagcggcaaatcgaatttttgccccggcaggtaggaaaaggtaacggcatccgtattaatgacggcaagcagcaggaagagcagcaggataatgattttgatgacggtatagataagtttcatgtttgctccgtaaataaaaacgccgcccagacagcttcgcactctgaaccaagattgcgctagtttaaacgatttgcacggtttcggataggatgcggcagcgtgttcggacgacatacggagtatgcgattgccgacaattttaccaaatacaccgttcctttccatttgaaaaataacggattggacaccgcatcgacagaaaaacccgccgcgcacttgtcaaaaccctgtttgcaggcgtatctttacaatcttcaaattcaaaccgttcattgaaacatatcagaataagaaaggctttacatcatgagcagacccgtacccgccgtattcggcagcgtttttcacagtcaaatgcccgtcctcgcctaccgcgaaggcaaatggcagccgaccgaatggcaatcttcccaagacctctccctcgcaccgggcgcgcacgccctgcactacggcagcgaatgtttcgagggactgaaagccttccgtcaggcagacggcaaaatcgtgctgttccgtccgactgccaatatcgcgcgtatgcggcaaagtgcggacattttgcacctgccgcgccccgaaaccgaagcttatcttgacgcgctaatcaaattggtcaaacgtgccgccgatgaaattcccgatgcgcctgccgccctgtacctgcgtccgaccttaatcggtaccgatcccgttatcggcaaggccggttctccttccgaaaccgccctgctgtatattttggcttcccccgtcggcgactatttcaaagtcggatcgcccgtcaaaattttggtggaaaccgaacacatccgctgcgccccgcatatgggccgcgtcaaatgcggcggcaactacgcttccgccatgcactgggtgctgaaggcgaaagccgaatatggcgcaaatcaagtcctgttctgcccgaacggcgacgtgcaggaaaccggcgcgtccaactttatcctgattaacggcgatgaaatcattaccaaaccgctgaccgacgagtttttgcacggcgtaacccgcgattccgtactgacggttgccaaagatttgggctataccgtcagcgaacgcaatttcacggttgacgaactcaaagctgcggtggaaaacggtgcggaagccattttgaccggtacggcagccgtcatctcgcccgttacttccttcgtcatcggcggcaaagaaatcgaagtgaaaagccaagaacgcggctatgccatccgtaaggcgattaccgacatccagtatggtttggcggaagacaaatacggctggctggttgaagtgtgctgatgctttaaataaaaaatgccgtctgaaacccgtttggcgtttcagacggcattttcgcatccgaaccgtttccgctgcacctgcagcaagtcggcacaaaggcaatcggttaaaacaagcgtccgcatttcccatcccgcctgccgtaagtcgggcatttccctagaaatacgcttcagacggcaaaacgccgcccgaaaccgatatgcggcacggacggcgcacggatttgaaaacggcggattatccctcggtgctcaaggcattaatgctgtaaccgccgtcaacgtaagtgatttcgccggtaatgccggacgacaggtcggacagcaggaaggcggcggtattgccgacttcttcaatggtaacgttgcggcggagcgggttgtgggcggcgacgtgtcccaagagtttgccgaaatcggcgatgccggaggcggcaagcgttttaatcgggccggcggaaataccgttgcagcggatgccctctttacccagacaggcagcggtaaagcggatgcctgcctcaaggctggcttttgccatacccatcacgttgtaattcggaatcgcgcgcaccgcgcccaagtagctcagggcgacgatggcggaatttctgccgcgcatcatcggacgggcggcttttgccaacgcgggcaggctgtatgcggaaatttcgtgtgcggtgttgaacgcttcgcggctgatgctgtcgaggaagtcgccgctcaaggcttctttcggcgcaaaaccgatggaatgcaccaaaccgtccaagccgtcccaatgtttgcccaagtcggcgaacacttggttgatttcgtcgtcgctggcgacatcgcagcggaatacaagttcggaatccaattccgccgccattttgcggacgcgctcttccagtttgtccacaacgtaggtaaacgccagttccgcgccttgttcgcggcaggctttggcgatgccgtaagcgatggaacgctcggaaatcatgccggtaatcagaatttttttgccttgcagaaaacccattttgtatccttcaaatagtgttcggttcgttctaaaccgttgattatagcaaattgtccctgtttctgtgttttcacgttgcagcgtgcaaacggcaatgccgtctgaagcggatttcagacggcattggacgtttcaaatacggtttaaggcatcagatgccgcgcaacaattcgttgacgctggttttcgcacgggtttgcgcgtccacgcgtttgacgatgacggcgcagtaaaggctgtggctgccgtctttggaaggcatactgccggatacgacaaccgaacctgccggtacgcggccttgatagatttcgccggttgtacggtcaaagattttggtggattgaccgatgaacacgcccatagaaatcacgctgccttcttcgacaatcacgccctcaacgatttcagaacgcgcaccgatgaagcagttgtcttcaatgatggtgggtgcggcctgcaggggttcgagtacaccaccgatgccgacgcccccgctcaagtgcacgtttttaccgatttgcgcgcaagagccgacggttgcccaagtatcgaccatcgcgccttcgtcgacgtatgcgccgatgttgacataagatggcatcagcacgacatttttcgccacaaagctgccgcgtcgggcaaccgcacccggaactgcgcggaagcctgcgtttttgaactcgtcttcagaccagtcggcaaacttggtcggcactttgtcgaagtatttgttcacgccgtcgttgaggacttcgttgtcttggatgcggaaggacagcaacacggcttttttcgcccattcgttgactttccactcacccacgcccaaacgttcggcaacgcgcagtttgccggaatcgagttggcggatggtttccaacacggcttctttgacttcgggagtaacggtggtcggggtgatgtccgcgcggttttcaaaggcggtttcgataatgttttgcaaagacataatatttccttatgtgagatgtttcgtgggacgcttgccggtattttcaagcagtatgttcatttgaaatgaatgcgctattgtgccacgcaaacgcatattcgtcagcaatacgcgagcggttgccaaacattggcgtttcggaatcgggcaggcggcaggtattgccttttccgcgcccgaatcaatacagaaaggcggcagtacttttatgccgcgccgccgcctttcagacggcattcgcggtaaaacgccatcagcccttcggtcgaggcatcgtgtacggacgtgccgccttccagttcgccgatgatggtttttgccaactgtttgccgtattccaccccccactgatcgaaggggttgacgttccatatcgcgccttggacgaaggttttgtgttcgtaagccgccatcagcatacccaaattgtagggcgtgaggcggtcaatcaaaatgctgttgctggggcggttgccggggaactctttgtgcggcgcgaggcgttcgcgttccgcttcgggcaaatctgccagttcggcgcgtgcttcgtccaaggttttgcccttcatcaaggcttccgcttgggcaaaggcgttggcaacggtaaaacggctgcgtccgtcctctctgccctgcgccgtcatcgggacgataaaatcgcagggaatcaggcgcgtgccttggtggagcagttggaaataggcgtgctggcagttgaccccttcaccaccgaacacgatgccgcccgttttgcacacggcgggactgccgtctgaagcgcggcttttgcccaaactctccatatcgagctggttcagccacgccggcagcaggcgcaggttgtggctgtacggaacggcggtctgcccgtccgcgtgctggaaattgttgtaccacacggcaatcagtgccattaaaacggggatattatgacgcgtcggcgtactgaaaaaatgcctgtccatcgcgtgcgcccccgccaacaactcgcggaaacgcgccccgccgaccgcaaccatcacgggcaaaccgacgggcgaccagacggaatagcgtccgcccacccagtcgtacatcgcaaacacgcgttccgccgcgataccaaaagccgcagctgccgcagtgtcggcagacaccgcgcaaaaatggcacgccgtttcggattccgagaaccctgcaccgcgataccacgccttgactgcctgtgcattgagcagggtttccggtgttttgaaggacttgctggcaacgcaaaacactgtcgtttcggggttcagacggcataaaaccgcatccaggcaggcaggatcggcgttggcggcaaaatggacggtgatatgccgtctgaacggctcaagtgcctgcacgcacattgccggcccgaggtcggatccgcctatgccgatgtggacaaaatccgtaatccgttttccggttatcccctgatacgaaccgtcgtccaaactgtgtgcaaacttcaacgcacgatttaactcgcggcggatttcgggcaacacgtccctgccgtccacataaacggcatccgcaccgtcgggcaggcgcaaagccgtatgcagcgcggcacgcccctcgctgccgttgactttcgcacccgtccgcaaagcacgcattttcccttccaaatccgccgcgtcggcaagattgcagagcagttgcagcgtatcttcgcccaaacggtttttgctgtaatcgaacaacatcccgtccaaacgctcgtgcatacgctcaaaccggtccggttcgcaggcaaagcggtcgcgcaaaaggacatgacgcgtatcctgataatggcgttcgagcgcataccatgcacgggtaaaagcattcatctgttttccttgatttttcagaaccggattaaaatgtagcagaatgtagtttaacaaacggcagcggctttggcgaatctccggaacaccgcccgccgcgtccaatagcaccttatttccatatggcggaaatgccctccggccggcatttgacccgcaacaatatcctgcaagatttattgtgtacgcataaatgccggacagccgcctaaataaggtataatcgcatccgattctgtcccgtttgccgcccgcaggcgggatgtcggcggttttcatcttaccgggaacacgccggtactgttttttaacgatgtttcttacattttattccaattactttacggggctagaatatggctaaaaacggaggattttctttgttcgcaaagaaagaaaaacgctttatctttgaaggcaggcattccgcctccgacaaactggtcaacggcgaagtatccgcgtttaccgaagaagaggcgcgcaaaaaactggcaaaacgcggcatccgcccgttgcagattacccgtgtgaaaacaagctccaagcgcaaaatcacacaagaagacatcaccgttttcacccgccagctgtccacgatgattaaagcgggcctgccgctgatgcaggcatttgaaatcgtggcgcgcggacacggcaacccgtctatgacggaaatgctgatggaaatccgaggcgaagtggaacagggcagctcgttgagccgcgcattctcaaaccacccaaaatatttcgaccgcttctactgcaatctggttgcggcgggcgaaacgggcggcgtattggaaagcctgctggacaaattggcaatttacaaagaaaaaacccaggccatccgcaaaaaggtaaaaaccgcactgacctatccggtatccgtcatcgccgtcgccatcggtttggtattcgtgatgatgattttcgtactgcccgcctttaaagaagtttacgccaatatgggcgcggagcttcccgcactgacccaaacagtgatggatatgtccgactttttcgtctcatacggctggatggtgctgatcgcactgggctttgccatatacggcttccttaaattgaaggcgcgttcgattaaaatccaacggcgtatggatgccatactgctgcgtatgccgattttcggagacattgtccgcaaaggaacgattgcccgctggggcaggacgacggcgacgctgattgcggcaggcgtgcctttggtcgatgtattggactccactgccggcgcggcgggcaatttaatctatgaagaagccacccgggaaatccgtacgcgcgtcatccaaggtttgtctatgacttcggggatgcgtgcgacggaactgttccccaatatgatgttgcagatgtcttccatcggcgaggaatcgggttctttggacgatatgctcaacaaagccgccgaattttacgaagacgaggtggacaatgcggtcggcaggctgtccgctatgatggagccgatcattatcgtgattttaggcttggtcatcggcacgcttctggtcgccatgtatctgccgctgtttaatttgggcaacgtggtcgcctgatttgccgcacagatccggcgcggattcgctctgcgccggtttgtttttgttttgaatacattgagaacaaaatatgtctgatttgtctgtattgtcgccgtttgccgtgcctttggcagcggtgttcgggctgctggtcggaagtttcttaaatgtcgtcatttaccgcgtgccggtcatgatggaacgcggctggacggtatttgccaaagaatatttaaacctgccgctgaccgaagaggaaagccgtaccttcaacctgatgaaaccggattcctgctgtcccaaatgccgcgtgccgatacgcgcgtggcagaacatcccgattgtcagctacctgctcctgcgcggcaaatgcgcttcctgccaaaccaaaatcagcatacgttatcccttaatcgagctgctgaccggcgtattgttcgggctggtcgcctggcaatacggctggtcttggattacgctgggcggattggtactgaccgcgtttctgatttccctgacctttatcgatgcggacacccaatacctgcccgactcgatgacactgcccttaatttggctgggtctgatatttaatttggacggcggcttcgtgcctttgcagtctgccgttttaggtgcggtcgccggctatggttcattatggctcttatgtgcagtgtataaactgctcacaggaaaaaccggtatgggcaacggagatttcaaactgattgccgcattgggcgcgtggctcggcatatccgcattgcccgtactgatttttgtttcctcgctgatcggtttggtcgcggcaatcgttatgcgcgtcgccaaggggcagcattttgccttcggccccgcactgacagtttcgggctggataatttttacggcaaacgattccgtatggcgggcggtcaactggtggctgacccatccggtgctgtaagatgacggtatgggtcggactgaccggcggaatcggcagcggcaaatcggcagccgcgcaatgttttgccgatttgggcgtgccgcgcatcgatgcagacgcggcggcgcactcgctgacggcttcagacggcatcgccctgccggaaatcaggcggctgttcggcgacaccgtttttgacacacagggtttgttgcggcgcgacatattgcgtaaagaagtctttgcctccccatcgcgaaaagccttgctcgaatccgtgatgttgccgctgattttctcagaaatcaaaaaacagcaagaaacctttactgatgcagcttacggcattgtcgaaattccgctgctgacggaaaagcgtcaatttatcagcctgatacggcgtgtcctgaccataagtgcccctgtggaaaaacgtatcggcagggtgatggcccgcagcgggctgacgcgcggcgaggtggcggccgtcatcagccatcaggcatccgaatccgaacgcctgctgcttgcagacgatgtgctgctcaatgacggcagcctcaaaagcctgcgtgagaaaacaatgcgcctgcacgcgttttattcagggattttcgcctcaaaaccaacacaaggaaaacacaatgactgaatcgcggcaaacacgccttcaagtcaaatgtccgacctgtcaaacagcagtagtatggaaacccgaaaacgcattccgccccttctgttcgcaacgctgcaaactgatcgacttgggcggatgggcagacgggaaatatacggtttccggccaaacggaaagtttgccggaaatatccgaacccgacatggcataccgctgaccgccccgccttcccggcaaacaccctgaaagtcaaatgccgtctgaaacaaacacgcttcagacggcattttcattctcaaacctaatcgttggtatttgccgttacctcttccaatgaagtaatgccctgcataactttcaaaataccggcccggcgcaaatccaccataccctccttataggcaacgtccaaaatatccacttccgtaccgttgttcataatcacacgctgcatttcttcgctgatgggcataacctcatacacgcccgcacgccccttataaccctgcccccggcaacggtcgcaaccgacggcgcggtaaagtttccaatcttttgcaaggtcctcatcggtgaagccgacttccttcaaagcagaggcagacgggcgttccacttcctgtttgcagctcgaacacagcctgcgtaaaagacgctgcgccataatcaggctgaccgaactggcaatattaaacggcgcgacacccatattcagcatacgcgacaacgtcgccggcgcattattggtgtgcagggtggaaaacaccatatgccctgtttgtgccgccttaatcgcaatatcggcagtttccaaatcacgaatctcaccgaccataatgatgtccgggtcctgacgcaggaaagacttcaaagcagcggcaaaagtcaggccctgcttatcattgacgttaacctgattgatgcccggcaggttaatctcggcagggtcttccgccgttgcaatatttaccgactccgtattcaaaatattcaaacaggtatagagcgacaccgtcttacccgaacccgtcggaccggttaccagcaccatcccgtagggacggtgaatcgctaccaacacaattttttctgaaacggctcaaaaccgagctggtcgatgttcaaagacgcggcatcggaattcaaaatccgcatcacgaccttttcgccaaacagcgtcggcaatgtgctgacacggaaatcgacaggcttgccgcccttttgaaaggtcagctgcatcctgccgtcctgcggtatccgtttttcggaaatgtccaaacgcgacattaccttaatccgtgaagcaagctgcccccttaccgcaatgggcggctgaaccacctcgcggagctgcccgtccacacggaaacggatacgggcattgtgttcgtaaaactcgaaatggatgtccgatgccccgctgcgcaaggcatccgacaaagtcttatggataaacctcggaacagggccgtcttctgcctcctcgttgtcgatatacagggtgtggctttcctcttcctcctgcccctccccaagctcctgaagcagcgatgtcgaacgcgaacccacccaatcgagcaaacccgccaactggtcatcctcgacaatgaccaactcaacctcaatccctgcggcagaaacggttttctgaatttgcggcatctgtgtcggatcggaaaccgcaaaaaatactttgtcgccccgacggaaaaccggcacacagtggaactccaccatctgctcctccgtcaacacccccatcagcaccctgtggcgcggataatgacgcaaatcaagaatcgaataactgaacaccctcgcaatcaatgccgcaagcgacttgggcgaaatgacaccgtctgaaaacagcatcggcaacacttccttacccgcctgcgactcattgtagtaatgctcggcctgctcaacagtaaccacctggttttgaaccagaatcctcagcaaacctacgctcatacgaccttatccccaaatttattcattgttatacctgtacagcttttatagtggattaaatttaaaccagtacggcgttgcctcgccttgccgtactatctgtactgtctgcggcttcgtcgccttgtcctgatttaaatttaatccactatatcataaaacaacagatttccaagccggaacatcttttacgaagcctgaaaatcatttcatgattctaccgtcctaaaggtcggtttttcaagcaggaagaaaaattttcagatggcaaaaaagccctccagcactgaaaggccttatatcggaaacttcccgcaacacgggaaacagacaaatgaaatcgtcaaacctcgccaacaggaatcgaacctgtattttacgcttaagaggcatacgttctatccgttgaactatggcgagccgaaatgaaaaggagattttaaccctttccgacgacaaaga

SEQ ID NO: 37839 - DNA, 13423 bp, Neisseria meningitidis
ggtatagacacgtccgttgcgtttcagaatgccgaagacaaccacttttcctgctgcaccgcgaccacgtctacctttacgccgtccgccgaaatcgctttcgtccggctcgacagggccctcaaaaacctcatcggcagccaaggctaaatgatggttgataaccgtgcggattttacggtagaacagtgctgccgaattgggatggatacccaaaatatcggcggcagaacgggcggtaacttccagtacaaaaaacggagcagttctttctgtacttttttctttaatttgcagtgcgttatcttcatatttcgagggtaacatatctgctaatctagtacagccccttaaatttagtccactataaaaaacggcggaaataaattttttccgcctcacttgaatttacccgcacacaccctaattttgccgacttatacgggcagctgcttgacggctgtccggtttccacttcaatctgcctgaaccgttcgggcagatgattgttttcaaactattttatcggagcataaatatgaccatccgtcctttacacgaccgcgttgtcgtcaaacgcttggaagctgaagaaaaaaccgcatcgggcatcgttttgccgggtgcggccgccgaaaaacccgatatgggcgaagtcatcgccgtgggcgcgggcaaaatcggtaaagacggcagccgccgtccgctggatgtcaaagtcggcgacaaaatcatcttcggcaaatacagcggccaaaccgtaaaagccgacggcgaagagctgttggtaatgcgcgaagaagatattttcggcatcgttgaaaaataaatacggacacgatgccgtctgaaacggcaaaccgccttcagacggcataaacggttttatcagacagttttaatgatttttggagaattgaaatggcagcaaaagacgtacagttcggcaatgaagtccgtcaaaaaatggtaaacggcgtgaacattctggcaaacgccgtccgcgtaaccttgggccccaaaggtcgcaacgtagtcgttgaccgcgcattcggcggcccgcacatcaccaaagacggcgtaaccgtcgccaaagaaatcgaactgaaagacaagtttgaaaatatgggcgcgcaaatggtgaaagaagttgcgtccaaaaccaacgacgtggcaggcgacggtacgactaccgccaccgtactggcgcaatccatcgttgccgaaggtatgaaatatgttaccgcaggtatgaatccgaccgacctgaaacgcggtatcgataaagccgtcgccgctttggttgacgaactgaaaaacatcgccaaaccttgcgacacttctaaagaaatcgcccaagtcggctctatttccgccaactccgacgaacaagtcggcgcgattatcgccgaagcgatggaaaaagtcggcaaagaaggcgtgattaccgttgaagacggcaagtctttggaaaacgagctggacgtagttgaaggtatgcagttcgaccgcggctacctgtctccttacttcatcaacgatgcggaaaaacaaatcgctgctttggacaatccgtttgtattgttgttcgacaaaaaaatcagcaacatccgcgacctgctgcctgttttggaacaagtggcaaaagccagccgtccgctgttgattatcgctgaagacgtagaaggcgaagccttggcgactttggtcgtgaacaacatccgaggcatcctgaaaaccgttgccgtcaaagcccctggcttcggcgaccgccgcaaagcgatgttgcaagacatcgccatcctgaccggcggcgtggtgatttccgaagaagtcggtctgtctttggaaaaagcgactttggacgacttgggtcaagccaaacgcatcgaaatcggtaaagaaaacaccaccatcatcgacggctttggcgacgcagcccaaatcgaagcgcgtgttgccgaaatccgccaacaaatcgaaaccgcaaccagcgattacgacaaagaaaaactgcaagagcgcgtggctaaattggcaggcggcgtggcagtcatcaaagtcggtgccgcgaccgaagtcgaaatgaaagagaaaaaagaccgcgtggaagacgcgctgcacgctacccgcgcagccgttgaagaaggcgtggttgcaggcggcggcgtagccctgttgcgtgcccgtgctgctttggaaaacctgcacaccggcaatgccgaccaagacgcaggcgtacaaatcgtcttgcgcgccgttgagtctccgctgcgccaaatcgttgccaacgcaggcggcgaacccagcgtggttgtgaacaaagtattggaaggcaaaggcaactacggttacaacgctggcagcggcgaatacggcgatatgatcgaaatgggcgtactcgaccccgccaaagtaacccgttctgcgctgcaacacgccgcatctatcgccggcttgatgctgaccactgattgcatgatcgctgaaatccccgaagacaaaccggctgtgcctgatatgggcggcatgggtggtatgggcggcatgatgtaagcaatgccgtctgaagctttcagataaaaaaccgcacggtcaacgccgtgcggttttttttgcgaataagtgcggctaaggcgcaaaccttaaaattgccaacgccgttctttgcatttttgttttttgatacgcgcgcttttgttttatttcccgccatcccaaaaacgaagagcggcaggaatttatcggaaaaacagcaacctttccgccgtcattcccgcgaaagcgggaatctaggtctgtcggtgcggaaacgtatcggataaaacggtttcttcagattttacgttctggattcccactttcgtgggaatgacgtggtgcaggtttctgtgcggatagcttcgtcattcccgcttttgcgggaatgacggcgacagggttgctgttatagtggattaacaaaaaccagtacggcgttgcctcgcctcagctcaaagagaacgattctctaaggtgcttaagcacgagtgaatcggttccgtactatttgtactgtctgcggcttcgtcgccttgtcctgatttttgttaatccactataaatgtgaaatccgccctttgaaaatcgggcggcggtttttgtttgcctgctttcaggcggcaaagccggttttcacgggtttctgcctgtttttcggatggtttgacgtgcttcggcggcgtgtttgccagaaaggtaaatgacagggtatgttgtatttcagatacggctttttggttgtttggtgtgcggcaggtgtttctgccgcctatggggcggatgcgcccgcgattttggatgacaaggcattgttgcaggtgcagcggtcggtgtcggataagtgggcggaatcagattggaaagttgaaaatgatgccccgcgcgtggttgacggggattttttgttggcgcatccgaaaatgttggaacatagtttgcgcgacgcgctcaacggcaatcaggcggatttaatcgcttcgttggcggatttgtatgccaagctgccggattatgacgcggttttgtacggcagggcgcgggctttgctggcgaaattggcgggaaggccggcggaggcggtggcgcggtatcgggaactgcacggggaaaatgcggcagacgagcggattttgctggatttggcggcggcggagtttgacgatttccggctgaagtcggcagaaaggcattttgcggaggcggcaaaattggatttgccggcaccggttttggaaaatgtggggcgttttcggaaaaaaacggaggggctgacgggctggcgtttttcgggcggcatcagtccggcggtcaatagaaatgccaataatgccgcgccgcaatattgccggcaaaacggaggccggcagatatgcagtgtcagccgggcggagcgggcggcagggttgaattatgaaatcgaggcggaaaagctgacgccgttggcagataatcattatttgttgttccgttccaatatcggcggcacgagctattatttcagtaaaaaatcagcttatgatgacgggttcggcagggcgtatttgggttggcagtataaaaatgcacggcagacggcggggattttgccgttttatcaggtgcagttgtcgggcagcgacggctttgatgcgaaaacaaaacgggtaaacaaccgccgcctgccgccgtatatgctggcgcacggagtcggcgtgcagctgtcccatacttaccgcccaaacccgggatggcaattttcggtcgcgctggaacattaccgccaacgctaccgcgaacaggatagggcggaatacaataacggcaggcaggacgggttttatgtttcgtcggcaaaacgtttgggcgaatcggcaactgtgttcggcggctggcagtttgtgcggtttgtgccgaaacgcgaaacggtgggcggcgcggtcaataatgccgcctaccggcgcaacggtgtttatgccggttgggcgcaggagtggcggcagttgggcggtttgaacagtcgggtttccgcgtcttatgcccgccgcaactataagggcattgcggctttctcgacagaggcgcaacgcaaccgcgaatggaatgtctcgctggctttgagccacgacaagttgtcgtacaaaggtatcgtgccggcgttgaattatcgtttcggcaggacggaaagtaatgtgccgtatgcgaaacgccgcaacagcgaggtgtttgtgtcggcggattggcggttttgaatggtgggataatgccgtccgaactttggaaacaggttcggacggcatttttgcgcgttcaggcaagggcggcggcaaatacgccgcgcaaggcgttggagaggcggatttcttcggcttcttgcagtgttttttgtgtgatgtgtgtttcgattacttgatttgtttgcaaatatttttgcggttcgtccaatacggcttggcgcattatgccgtttaaaatgtctaaatctaaagagggtgtgagccattgtccgcgatgtttgatgaagacgttgcttctgccgccttcgagcaggatgccgtctgaattgaaaaacaggctgtcgaacgcgccttgtgtttcggcggtttgccacgcttggtcgaagagggcgcggcaggtggttttgaagcggcgcaggtagttttgtgcgggcaggacggcgggcgaaatgatgacgcgttgtttgtcggtcagacggtttaaaacggcgcgggacaggctgatgccgtctgaagcgagcagggctttgacgcggaacgcgccatcgggcaagtcggcaatgtattgtttgatttgattttcgcagccgtcgggcaggggcaggttgagggcttgggcggaggttttcagacggcataggtggcggtcgagcagggtgcagcgtccgttttccgcgcgcagggtttcaaaaatgccgaagtcggggcgcaattcgttgaggaaacgggctttccagccgcattcgcgatattcggcggcggggtcgctgtcgatgacgatgccggaaccgacaccgtacacgccttgataaatgccgtctgaaagcggcgtgagcgacaaggtgcggataacgacgttgaacgtgccttcaaaccccaagccgccggaacacgggttcaaatagccgatgctgcccgtataaagtccgcgcgcttcggcttcgagcgattcgataatctgcatactcatttttttgggcgcgccggtgatgctgccgcaggggaaggcggcgcggaggatgtcggcgaacgaggtgtgcggcaaggcttgggcttggatggtgctggtcatctgccaaacgctgccgaaacgcgatactttaaacggttcgggtacgcatactgtgccggtttgggcgattttgccgagatcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccctccgcatcgggcaggtgggacaagacggcataggggacgggctggcgcaggcggcggtagaggctgacgggattgccgtaggcttgcaggtgcaggcgggtggtgtagttgatttgataggtgtcgccgcgccggatggcttcgtggatttggcggatgcggtcgaggtaatcggtttcggatacggagggttgcggcgtggaaatgccggcggggaggccgtctgagtgtcgggcaagccagctttcggcatcgatgtcggcgcagttggcaaaccagtgcagggcaagattgccgccgcgttcggactcaacccccgtcagcggcaaaccgaatccgtagtctgcaaacaacaccgaatgcagccctttttgccagcccgattgcagcgcgccgtccaaagcatcgagttcttcgggacggaaaaaacggctttccacatgattttgatagcgttttgcgcggccgcttacggcatcgtcaaacagggcgaaataaggcatggcaatccggggcaaatgttttgattatacgccccttattacacatattttcagacaattcggcaaatatcggcaaaatgtaattttatgtagagaaagcgggggcgaaggtgtaaaattgtgaaaacaaattccgatttccaacctgaaatacaataaggagacctttatggcagaccaccagctgcaaccgtttgaaaacgtagaattaggcgaaaagcaagaccagctccaagtatagtggattaacaaaaaccagtacagcggtgcctcgccttagctcgaagagaacgattctctaaggtgctgaagcaccgagtgaatcggtttcgtactatctgtactgtctgcgtcttcgccgccttgtcctgatttttgttaatccgctataaagaccgtcgggcatctgcagccgtcattcccgcgcaggcgggaatctagtctgttcggtttcagttatttccgataaatgcctgttgcttttcatttctagattcccactttcgtgggaatgacgggatgtgggttcgtgggaatgacgtggtgcaggtttccgtgcggatggattcgtcattcccgcgcaggcgggaatctagaccttagaacaacagcaatattcaaagattatctgaaagtccgagattctagattcccgctttcgcgggaatgacggaaagtggcgggaatgacggttcgggcattccttaaatcacccgtgtatcgctgtaaatcttagagatggtggaatatagcggattaacaaaaaccagtacggcgttgcctcgccttagctcaaagagaacgattctctaaggtgctgaagcaccgagtgaatcggttccgtactatttgtactgtccgcggcttcgccgccttgtcctgatttttgttaatccgctatacatctgattaatgccgaatctttggaagaagtcttgaaacaatagaagcaggcaattggaatagggttttcttttcataagaaacagccgcaaagaccgtgatctttgcggctgtctgcttcctgtccgtcagaaccggtagcctacgccgactcgtccgctgtggttgccgtactgtttggaaccggcgtagctgtaacgtgccaagccgttccagccgttgccgaattcgacatccgcgcccaggccggcaaccagacgggtgtgcggcatattgcgtgcccccgtcttgccggttgctgcagtcgcgccggtaaagccgcccgttaccgtgtagtcgcgtccgttcaggtcgcgttccacgcccgccgttgcaaacaggacggctttatcgctcaagggttgcgacagcttcagacccgcgagtccgaccagcgtgccttcagtgaggctgttgccgctccagcccaaagcactgcctttttcggcgaatgcatcctgtttgagcaggtcgtagcgcagaccgccttcgaccgtcaaatctcccgttgcggcaaacggaacgttgacaccgcccagtgcgcccagctgcatcagcgtgccgttgacgctgccttccgcatgttcgtccgcaccggtgctgcggctgatgctgtttttgtagcgtccgtaggagaacaggcctttgagatagccgatatcgcccgcatcgtgccgtatgcctgcaaacagactaatgctgtcggtttttgcatttgcactgttttcgctccatgtgctgcgtcccatgcccagtgtggcggctgctgtcgtattttcgccggttttcgcggcaatgccgacggtttgggtactgccgcgcattttgccttcaacaccgccctgttcccacgttccaccgtcctgttgggtttgcgcgatgacgcgcagacccgtgccgttgtggtccaacccgtccgatacggctttcaggcggcgtccctgcatatcggcatgggcggcggtactgtcggcatagacggtagcggcgagactgttgaagatgcgtacaccgtcggcggcattcgcatgctgtacggctgccgctgcgcggaaagttgcgccgtaggggcggatgcccggcatatctgtgcggtcggctgccgcagtttcaaccgtctcgggtgttgcggatgattcggaggcatccagttcgaccatcaggttttccagattgctgccgccctgttctacggcgtgtttcagaccggcgggcgcggaatgtgccgctgccgaagcagtccgtgccgcattgccgcgacggacataataggacagcgtgtcgccttcactgcccgctgttttttcgacgctgtcgagggaagccagcaggccgccgtcggtttcgatgtttgtgaagaaagaataatcctgcccgattttggcggcactcaggaagggaacacgtcgtccggtactgttgagatagcctgcccccttgccgcgtgccgacatgtacagcttgccgccgataatcgccgtaccgtccactttcagcagtttgcccaaacgtgtgtacagcgtacctttgccgtccagctgcagactgcctttgatgtgtacggtttcgtttgcgccggattggtcggtatctgccagatagacaatgccgtcgctgttcaggctgccgccggatgccgccccgttataaatcagcgcacctttggtttcgacgcgcatatccgatttgttgttgccgtacaacaccagcgaaccgccttcgataatggttttgcccgtataggtgttgttgccgtgcagttgcagttggctgccgccttttttgatcaggccgcccgtgcctgaaatgtcgttacggaaggagtaggcaatatcggatgtacctttcgtatcggcggtaaagtcgccgaacggaaaggacgcgggtccgttcatggccttacccgcatccagcagtccccagccgaacttgctgtccacgccgactgcaccgatgtcctgagccgtcgtcagcaacgtggtacgcaggttgtcgttgctcatccacgggtatttctgcagcagcagagccgccgtgccggttacgatgggtgcggaaaaggatgttccggcaatttgaatcgggtttgtacgggtgaaacggacgcttgcttcatagggtgccgacaggcaccacatggcagtaattccgcaatggttggagccatactcaagcggttctgtacccggttctccatacatttcccgtttgaacttttctccactgcggtctacgcctgcgactgtgataatgcctttttgagcgtctttttcataaaatggcaatagggcatatgtgttgggctgagcttgtgcgtcattgcctgtcgaaaagatgaaaagcatgtttttattacggatgtggtaggacaggttgccgtaatcgctctgttgcatcaggcggataccctcgtctgttttatcaccgccggaatagtcgagcaacgcttggcggtactgctcctccgaattggctatttggaaaaggtcggcagtgcctgccctcgatgttgttccaaaactgttattgacgatgcgcacgccacgttcgcccagcttgacccatgcattgcggatggctgcaaccatcatttcgttcttggtttcatcattcgtattcattatgtgtagcgtcgcatcgggcgcaataccgcctgcaggtctgccgtccacggaacgcccgccaataatatgggagaccaaatcgatgtgtccgatttcttttacgtggcggatatccgtcggctttgcttcagtctctataacggcctcatcgtcgaaagaagcttcaatgtctttaccgcctccgtcttcaggcgcttccttccgcatatacgccgtatagtttttgtaattttcgttatagccgtgttcttttctgccatacagttcgggaaaggatatgctgccgacggattcgcctgtgtcgacgatacctacctctaccccgcgtcctgtatagcctgcttcaattgcaggtttgaggttgatcaaattcttgtatgcgtcatttgggtttggaaagtctccggtatgcagattcggggggggggcattgattttggcatccctgtctgtaaccgcaacgtcatcccgaccggcacagagcatgcttctgtctttgcacatttcgttcttgataccggcgtaagatactgctgctgatttcgctgttgttgctctgctgttgctgccgataccggtaccgcctgcattgaagtcgggcgcagaagtgccgcctccgccgccgcctaagcaggcagaaagtgttgttgcaacagctaacgccatggcagtcggtttgaaagtttttgtagggaaggttggggtcgttcgcatgatgaggtctccttgaatctgacaatagaattcaggcgagggaataaaaattccgtaatgtttagatgtaacccatttttatattttgaattatattattataggggttgtcttggacaactaggataaactcgattttactaattgttttaaaatggaaatttgaactttcgacaaatagctcaatgagtttattttgtttataccggcttagacggctttttctcatagggataattctaacttaatttgaatttccctagttatagtggatgaacaaaaaccagtacggcgttgcctcgccttagctcaaagagaacgattctttaacaagtgaatcggttccgtactatctgtactgtctgcggcttcgtcgccttgtcctgatttttgttaatccgctataaagaccgtcgggcatctgcagccgtcattcccgcgcaggcgggaatctaggtctgttcggtttcagttatttccgataaatgcctgttgctttttatttctagattcccacttccgtgggaatgacgggatgtgggttcgtgggaatgacgtggtgcaggtttccgtgcggatggatttgtcattcccgcgcaggcgggaatctagaccttagaacaacagcaatattcaaagattatctgaaagtccgagattctagattcccgctttcgcgggaatgacgaaaagtggcgggaatgacggtttgggcattccttaaattacccgtgtatcgctgtaaatcttagagatggcggaatatagcggattaacaaaaaccagtacagcgttgcctcgccttagctcgaagagaacgattctctaaggtgctgaagcaccgagtgaatcggttccgtactatttgtactgtctgcggcttcgccgccttgtcctgatttttgttaatccactatacaaagacaaaaacatcgacctcggtcatgactgattgccggtgaagcaataaaaatgccgtctgaacctgaaaacgggttcagacggcattttctatcggggttttaaagcggcattaaatgtcggtttccaaataaacgacttgggtttgcagatattcttccaaaccgtgtttgccgtccgcgccgccgataccggattttttccaaccggcgtggaaaccctgcatcgcttcaaagttttcgcggttgatgtaggtttcgccgaattgcaggcggcgggtaacgtagaaggcttcgtttaaattagtcgtataaacagaactggtcagaccaaactcgcaatcgtttgccaaggcgatgacttggtcgagcgtgtcgaaagcggaaacgggcagcacggggccgaaggtttcttctttcataatgtccatactgttgtcggtgtcggtcagcagggtcggctcgaagaaataaccgcgtccttcggcgcgtttgccgccgcaaaccaatttcgcaccttgtttgactgcccgttccactttttcggcaacggctttgacggcgcgttcttcaatcagcgggcccatttccagcgcgcctgcttcggcttcggcagggttgccgtagcgcacgcctttcatcgcggcggtcattttttcaatgaatgcgtctttcagactgctgtggacatagacgcgctcggcgcagttgcagatttgaccggtgttgccgacgcgcgaagccaagatggatttcaccgccaagtccaaatccgcatctttcaaaacgatggcaggcgctttgccgccgagttccagcgaaactttggtgatgttggcggaggcggcttccatcacttggcggcctgcttcgacggagccggtcaggctgaccatatcgacttgcggatgggcggacaaggcattgccgatttccgcgccgggaccgttcaccacgttgaacacgcctgcgggcagtccgaccgcatcgacgatttcggcgaagatgtggcagttgatcggggttacgctgctgggtttgacgacgatggtgttgcccgttaccaaagcggggcccattttgcgggcaatcaggaagaaggggaagttccacggcaaaatgccggcaattacgcccagcggacgtttgaacaataaaatattttcgcgcgggcggtcgctttggatgatttcgccttcgtagcggcgcgcccattcggcctgataatcgagatagtcggcggtgaacatgacttccacgcgtgccaagtctttggttttgccgccttcggcaacgatggtgtcggtcagctcgtcggcacgttcgcgtatgccttgggcgattttacgcaaatacgcgccgcgttcgaccgcaggcagacgctcccaagccggttgcgccgcacgcgccgccgcgacggcgcggtcaacgtccgccttgccgcctttgggttcgcgggcgatggcctcttcggtggacgggttcaatacgtcgcgccattcgccgttgaaatcgttttcaaagcgtccgttgatgtacatggccaattgtttcatttcgggttctccagttttgtagttagatgtagttttagtttattcccaaataaattgc

SEQ ID NO: 37840 - DNA, 33962 bp, Neisseria meningitidis
gatctaagcgacacagccggggcgaacactgaggcaatctacacttcagacggcattaccgccaactctacccaactcgaacagctcaaaaaactgtttcccgcctgttttgacgcagacggaaatttccttatcgacagattacaagccgaaatcgcgccgcagaccgacatcggacgcgaattttacgaaatgaactggctgggcaaatcatatgctcgcctgcttcgcaacctgccgcccgaaaccctgataagtgaagacaagacgcacaacgccaagcccgaaaatgcaggcagccaaaacctgctgattcgtggcgacaatctagaagtgttgaaacacttaaaaaacgcctacacaaacagcgtgaagatgatttacatcgacccgccctaaaacaccggatcagacggctttgtctatcaggacgaccgcaaattcacacccgctgaacttgcccgcctagccaatattgatgaagacgaagccgcgcggattttagatttcaccgacaaaggctcaaactcgcacagcgcatggctcacctttatgtatccgcgcctgtatgtcgcccgcgaactgttaaaggacgacggtgtgatttttatctcgattgacgataacgaagcggcgcagttgaaattgttgtgtgatgaagtgtttggggaagggaattttgttgcacaattgccttggcgaaaaagaacagctaaatcagatgtgccttttggtatttcgcaggattatgaatggatatttgtattcgcaaaatcttgccaatttattgcagcaactaaaggcaaggaacgacgctattatgagactgatgatttccccgatcgtccttggcgtacccacgacttaacgaaacaaacaactgcggcggaaaggccaaatagttttttcacaatggttgatcccaagacaggaaaaaaatatccagcaaatccaaatgcaacttggcgtgtaaccaaagatacatttcaagattattataataaaggaaaaatcgttttccctgatgattatgatttcttaaatatcagcaatccagttatgcgttactttaaagatgacgacatgaaaaaagctggcgaggattttggcaaagtagctgtaagcagtagattacctgaaaatgttggtacattagccgatgcagtagccgaatatttggctatttttagtaggacgctacctgaaaatatcggaatgactaaagaaggcacaaaagaaatcacagatttatttggtagcaaaatatttaccttccccaagcctagtcaattgattaaatttttagtttcaataagttcaaagagtaatgacctaatcctagacttcttcgcaggcagcggcacaaccgcccacgccgtgatgcagcttaacgccgaaggacaaaacggtaaccgccgctatatctgtgtacagcttcccgaaaaaaccgctgaaaaatccgaagcccgtaaagcaggctacccgaccatcttcgacatcaccaaagcccgcatagaaaaagccgccgccaaaatccgcgtcgaacatcccgattacacgggcgattcgggcttcaaaatctttcaaacggcagacaatttcaggcagcatccggacaaggatttttcgcccgaacaaccggatttgccgcttaacgatgaattaagcgaagaacagctgcaaacgcttctgaccacctggacgctgtatgacggggcggcactgaccacgccggttgagcctgtgcggttaggggcttacacggcgtatctgtgcgaaaaacggctgtatctgatgaatgccggttttacttccgccgatttgttggcgtttatccgcaagctggacgacgatgcggatttcaatcccaaccgcgtgattgtattcggcagcaatatggcaagcgccatgcagcacgaacttgaccaggcggttcgcggttatgccaataaaaaagagattgagttgaatgtggttatcagggtttgacggaggcaattcatgagcggttttaattacgagaaaaaccagccgcaccaaatgcgggcggtttcggcggttttgggcgtgtttgacggggcaacgcccaaatatcggacggcagacgaaaatcccgaacttttgtttgctgcaaaacaatacgcaaacaatatcctgaaagtgcaaagccaaaacggtatagacggccgattccccgaccgttcggacgaccaaaatatccttgatatttccatggaaacgggcacgggcaaaacctatacctacacacaaaccatgttcgagctgcaccgttggctgggcgtgttcaaatttatcgtggtcgtgccgactttgtccattaaggcgggaacacagcagtttttgcaaagcaaggctttggcagagcattttgaacaggatttcggcggcgattatgaaggcgtacgcctgaaaacctatgtggtggaaagcgcgaaaaagaataagggcaaaaagtccaatgcgcccataacgattgagcaatttgtcaaagcggaaaacaaaaaggaaattcatgtgctgctgattaacgcgggcatggttaattcgtcgtccatgaacgatacgggcgacaaggcattgaaggatttgtttgacaatcccgttgatgcattggctgccgtgcgcccgtttatgattgtggacgaaccgcataaattcccgacccgagatagcgcgaaaacgtggggcaatatcaaacgcttaaaaccgcaatatattttgcgctacggtgcaacatttaacgatgaatattacaacttgctttaccgtttgacggcagtagacgcgtttaacgacgggctggtcaaaggcgtgcgcgtgtttcaggaagaaatgcagggcggcatggatgcggcggtaaaactggtgtcgtcggacggcaaagaagcgaaatttgaattaaacgaaaaggacaaaaagcagacgttcaaactggcaaaaggcgaagatttggcgcaaatccatccggctatttcggatttgaaaatcgacaaaatgaataaaaccgtggtggtgttaagcaacggcttggagttgaaaacgggtgccgtcatcaacccttattcctattcgcaaacggtgcaggatgcgatgatgcagcgggcggttgccgaacatttcaagctggaacgcgcgcttttggcagaacgcgcgccacagcccaaaatcaagccgctgacgctgttttttattgacgatatcgcgggctaccgcagcggcaacgagctttcaggcagcctgaaagataaatttgaaagctggattcgcgcggaagcggcacgccgtctgaaaacggaaagcgacccgttttaccgcgattacctgcaaaagacgttggacgatgtatccgcctgccacggcggctatttttccaaagacaatacagacagcgacgatagaatcgagcaggaaatcaatgaaatcctgcacgataaggaaaaactgctgtctttggacaacccgcgccgctttattttttccaaatggacgctgcgcgaaggctgggacaatcccaacgttttccagatttgcaaactgcgttccagcggcagcacgacttccaagctgcaagaagtcggacgcggcctgcgcctgccggtaaacgagctgatggcgcgggtgcgcgatgtaccgtacaaactgaattattttgtcgatagcagcgaaaaagactttgtgaagcagcttgtcggcgaaatcaacgacaattcttttcaggaagaaatctccaaaaagtttaccgaagagctgaaacaaaaaatattgcaaaaataccccgatatcaaaccgctggtattggtaaaccaactgtttttagatggcatcattgacgacaatgaaaactttgccgaagacggctatgacaaattaaaagccgcctatcccgaagccttccccaaaggtttggacaaaggcaaagtcagcaacgccaaagacgaaggcaaagacaccatcatcatgcgcgaaggcaaatatgaagaactcaaagccttgtgggagctgattcaccataaagccgttttgcagtataaaatcaaggatgaagccgaatttgccgatttatttaccgcctatttgcatgaaaacgctgccaaattcccacaggcaggcatacgcacggcggtaaacgaagcttatatcaacaacgggcttatgctttcccgccgcatagacagttttgaagatgaagattttatccgtttcaacacaatgacttaccgagagtttctggaaaaactggcacaaacggcaaaaatccgtatgcagactttgcatcaggcgttttactgcatccgcaacgaactgaacattggcgattttttgaatatgcaaaccatcgcccaaatcaaaaacggcttcaaccggtttttgcttcatcattccttccataaattcgaactggattaccggcttgtcggcagcaaaatccatccgaccaaatttaccaataaagacggcaaaccgcgcgcggtgaaaaaagcagatttgggcagatttgaagatacggagcaccggcctgccgccggctatctcttcggcgagattttctacgattcggatatagaacatgaaaatgtcgccaacaaccaaattgaaggcgtaatcgtatttaccaaaataccgagaaactccatcaaaatccctgttgccggcggcggcacgtattcgcccgattttgcctatatcgtgaaaaccaaaagcggcgagatcctgaactttgtgattgaagccaaagggactgacggggcggaagatttgcgaaaaagcgaagagcggaaaatcaaacatgccgaaaagctgtttgccgagatttccaaagaaatcaaggtggtgttcaaaacgcagtttgacggckagaggatagccgaactgatcgggcaaaatatgcccgcaggcgggcattctgaaaacgggcgttaaagaacgaatgttcggggcgcgtgccgtctgcttcgggattttaaaatgcccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaagggcgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataaaggggtcgatgtgctgaatcagctgcgaatcgagcttatagggttgtcgcttacgctgtttgatagtccggctttgccgctgggctttttcggcgctgtattgctgcccttgggtgcggtgccgtctgatttcgcggctgatggtgcttttgtggcggttcagctgtttggcgatttcggtgacggtgcagtggcgggacaggtattggatgtggtatcgttcgccctgggtcagttgcgtgtagctcatggcaatctttcttgcaggaaaggccgtatgctaccgcatactggcctttttctgttagggaaagttgcacttcaaatgcgaatccgccaagttctaattttctaaagttttcaccttttttccaccaaggcacaatatagttttttacagtgattttttcatctttaagggttataagactatcatcgtctctttgcggatcagaaaataaagacacccattccatctcttgaatattagtatattcatgggcttccgcctcaaaacataatgccgattaaatcaacaaagcaatggtagataaagcaaattttctattttagtctccttaatgtttaattgaaacgctgatttgggtattgtcatgccgatgcggaatcggtctccgtgccggatatattgtgtgaagtctctcgtcttttccagtatgcgcctaatatcggcttaaggcaaacggaggggcggaatccgtatgcggcacgccgccgttccctgccgtataatcatattgtttgaaaacctgttgacggagccgttatgaccgatttgtttgcccgagaacccgacgcgccgcttgccgaacgattgcgtccgcatacgcttgacgacgtggtggggcaggaacacctcatcggcgaaggtaaacctttgcgcgtggcggtagaaggcggcaagccgcattctatgttgctgtgggggccgccgggcgtgggcaagacgacgttggcgcggattttggcgcagagtttcaacgcccagtttttgcctgtttccgccgtattttccggcgtgaaggacatccgcgaggcaatcgataaagccgaaatcgctttgcagcagggacgcgcgacgattttgtttgtcgatgaagtccaccgcttcaacaaggcgcagcaggacgcgtttttgccgcatgtcgaaagcggtttgctaacctttattggtgcgacgacggaaaatccgtcgtttgaagtcaatcccgcgctgttgagccgcgctcaggtgtatgttttgcaacccttgtcttcagacgacctgaaaaagctgattgccaaggtattggctttgcctgaataccaagagtttacgattgaaacggatgcgcaaaaattactcgtgaataccgccgacggtgatgcgcgcagattgttgaatttgttggaacaacttttacgcgccgccgatacacgtcgtctgaaaaacttaaccgccgaatttctcgccgacagtctcggggcgcaaatccgccgtttcgacaaaggcggcgagagtttctacaaccaaatctccgccctgcacaaatccgtgcgcggttcgcatccgaacgccgcgctgtattggttctgccgtatgctcgacggcggcaccgacccgcgctacctcgcccgccgcatcgtgcgtatcgcttgggaagacatcgggcttgccgacccgcgcgccttccaaatcgccaacgatgccgccgccaccttcgaacgcttaggctcgcccgaaggcgaactggctttggcgcaagcggtattgtatcttgccgccgccgcgaaatccaacgcgggctacaaggcatacaaccaaatgcgccacttcgtcaaagaaaacgctagcgacgaagtgcccgtccacctgcgcaacgccccgaccaagctgatgaaggaattgggctacggacgcgaataccgctacgcccacgacgaaccgaacgcctactccgccggcgaaagctatatgcccgacggcttggacgaaccggacttctaccaacccgtcccgcgcgggttggaaatcaaaatcggcgaaaagctggaatggttgaaatcgctggacgaagaagtattaaaggcaaaatgaagcaatgctgtctgaagcagaacagtatggcaaagccggtacaccaaaaaggcgtatcggctttttttcaggtcttatcctgtttattgataaagccaataaagacaacgtggtatagtggattaagtttaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatattaatcgacgcatcgggcttgggcgaaaaaattaaagacggcaaaaaaaccgtactttcccgcgaagaagaacaaaaaaatctgcaataccttcacgcacaaacaggcagtggaagatttcagtgtggtaatcggctacgatgaaatcaaagcgaagaatcacagcttgtcggcggggcagtatttcgaggtaaagattgattatgtggatatttccgccgacgaatttgcgcaaaaaatggcgggattttcagcggatttggataaacttttcgccgaatctgccgaattggaaaaagagattaaggatagattggcgatgttgaaattcaattcataaataccgatgaatgaaaccggtcaaacttaaaatgccgtctgaaagcctttcagacggcattttgtttggtttggaaaatacttatgccgttctttccctgaaagagagaatccaaaaaaccaaagccacaggaatttatcggaaatgacaaaaacccgacgaaccggattcccgccagcgcgggaatgacgaattagaagttacccgaaatttgaaaaaacaaaatccaacccaacagaccgggttttcgtttgcacggaaataatgcaataaataaagcaaatataaagtatttgaatttactatattatttttccgcttcttcaaagccgacgacttccaaaccgaagccggtcaggccggtgaaagatgagggctgcccgaggacgcgcagttttttgacgttgaggccggcgaggatttgtgcgccgatgccgtagcttttgctgtcccatttgtaggcttggtttgcgcctttgggtagggttcggtcgagcagggatgcgccgtcttcggtgcggtgtaagaggatgacgacgccgctttcggcttgttggatgtgctcaagggctttgggcagcgaccatgaatggcgcgggttggcttgaatgaagtccatcacactgaagggttcgtggacgcggacgagggtttcggtgtcggcggcgggcgtgcctttgacgagggcgaggtgggtttcgccggagagtttgtcgacgtaaacgtgttgttggaactcgccccacggggtttgtacaggcgcattgcccatgtcttcaagcaggctttcggtacggctgcggtattcgatgaggtcggcaatcgtgccgattttgagcttgtgttcttcggcgaatttcatcagttcgggcatacgcgccatcgtgccgtcgtcgttgatgatttcgcaaataacggaggcaggaatcagcccgttcatttgcgccaggtcgacgccggcttcggtgtgtccggcgcggacgagtacgccgcctttttgggcgcgaagcggaaagatatgaccgggttggacgatgtcttcgggtttagcggtcggggaaacggcggtttgaatagtcagggcgcggtcggcggcggaaatgccggtggtaatgccgtgtgcggcttcgatggagacggtaaagttggtgccgtattgcgcgccgtttttttgggtcatcatcggcagcccgagtttttcgaccatttcgccgtccatcggcaggcagaccaagccgcgcgcgtgtttgatcatgaagttgatggcttcgggcgtgacgaattgcgccgccatcagcaggtcgccttcgttttctcggtcttcggcatcggtgatgatgaccattttgccggctttgatgtcggctaggatttcggggatgggggagatatgggacatggtgtgttttcctgtgtgttcggacgggcgggcggtgtgttcggtatcgagccaaaaggcgggcatttttgccgcctgttcgattttacgggcttttttctcgccgaaggatttgtttttcaaaagggcggagagttcgcctgtgttgagggcaacggcttcagcaaaacgagtttgcaaaccgccgtagtatttttctatccactgccgcaggttgtggcggcgcagaccggctgtgtcggtcatcgtttcatcctttgtagaaatcggatgtagcggattgtaatcgcgtatttaccaaaaagcaaatctgtttttttcgccaaaccgaattatttgctttttggtaaacagatgccgtctgaagccggattcgtggcttcagacggcattgccgcaatccccgccggcggggcggctgtttcttcccgcccgcttccgattcggggtttgccggaagcttattccgaaaaaaatttctgataaacggccttgattgccgggtacagcataggcggtacgagcaggcgcaatatcggcaatcctatgatgaatgcggtcttcccgataaaaaccggacggattgccttcgcgccgaatatctttctgcatttttctttaaatgaaaaatatttccggtagatgaggataatgtttttggaaaaataaagccttaccaatatagacctcagatagccgatattgtcgaagacaaatttttgcaaaccgccgtagatgggggaatttttgttttcgactaaaaaatccacaccccagtcgagatgcgtcagcacatcgctgaaatttttgtatttgatgttgtggctgatagagccgccgagaacgcggtactggtaaaaagggttatcgtaaaaggcaaaagtcttgataaaacgcgccaattgcaaactgtacgggaaatcctcgtgaatgtatccttttgggaaaaacagattgtttttaatgatgatttcccgcctgacaatctttgtccacgcgttggcgatatagtaccgcccctccaccagcgtttcaaaatggcggacaaaatcattatccgaaaagtccgcccctttggggatgtcgcggtaattgaaggacgagggatgcaggatcaaatcaacctttttgtctgcaagttgttgtaaatcaaagagaatccccccccgcgttttttgaacggttggtatcggcccaataatcgtcgctgtccaaaaagattaggtaatcgccttttgccgcccggataccggcgttgcgggcatccgacagcccgccgttttcttgatgaatcacttttatatgcggatatttgcctgcatattcgtcgcaaatcttcccgcagccgtccggcgaaccgtcatcgaccaaaatcatttcataatcggcaaaattttcggcaagcacggaatccacgcagcagcggaggtattttccacattgtaaatagggacgatgatggagaaaatcataaatatcaatccattatattaagatgtttgcgcgtatgcctcaaacccgcgctcgcaatgcgtttgcatccgcaccctgtaactttatatagtggattaacaaaaatcaggacaaggcgacgaagccgcagacagtacaaatagtacggaaccgattcacttggtgcttcagcaccttagagaatcgttctctttgagctaaggcgaggcaacgctgtactggtttttgttaatccactataaaacttattgctttatcaaggtatggaaacctgtttcccgaaaggcggcgcaggatgcccgttccctgcaactttgccttattccgacatcagatgtcccagcttgtctgctttggtttggaggtagcgtttgttttcaaggttttccccgacgtgcagggggatgcgttcgaccacgttaatccccgcatctttcagggtttggattttttcggggttgttggtcagcagtttgaccgagcggatgcccagatattcgtagatagattgcgccaaacggaaatcgcgggcatcgacgggcagcccgagtgccaaattggcttcaaccgtatccataccttggtcttgcagatgataggcgcggattttgttaatcagcccgatgccgcgtccttcctgacgcagatagacgatgatgccgcgcccctctgtctgtaccgccctcatggccgcttcaagttgaggtccgcagtcgcattttctcgagaacagcgcatcgcccgtcaggcattcggagtggatgcgcgtcagaaccggattgccgtctgaaaaattaccgacggtcagcgcgacgtgttcctgcccgtttgcctcttcaaagccgtgcatcgtaaatacgccccattcggtcggcaggcggcaggatgccacatggttcaacatttcagacatcttcactcccatcttttccggcagacatacccaacagcagtttcaaaggttcggacaaagccaaggcaagagccacccattccacctgtgctgccgtacccgcacactctgcgcattcaaattccacatgaaccacgcccaacacaccgccactttccgtgcagaccggaatggaaatttgcgccgccgaagcatgattgcgttctcccgaaagctcccccaaatccaaccaacggcgtacatccgaggcaacattcatccaaccgctttgcgccgaacggcaagccagcgaaaccttgcctgccgcttcatccaaatcccacaggttttccaaaacctcgccctgtcgggacaggcatatcagttggaaagcctggttttcagatggcatcaaggcatagaccgccgcactccgcacgcctgtcgagcgcgaaaacaccgaatccaaagccatgaaaagccgtttcagtgcatcttcgcggacattgtcgcacgacaggtaatcggcaagtttccaaccctcatcactgcgccacaaaaccgaacggtctatcgaagccgtccccatatccattaccgtctgcgccgtcagatacgccgcccgaacctcgtcaagcggcagcttcaaaccctgagtcagcagaaaatccttaatcaaagcagcaggcatacccaaattccgtcaataaaaacaaaaaaccgcccgattccgatgtcaggcggacgaaaaacagattttaccgccccaaaccccaagccatcaacagccccgccgaaaaccttgcacaaaaaaacaaaatctgtataatcgtccaattcccatgcggacgtggcgaaattggtagacgcaccagatttaggttctggcgccgagaggtgtgagagttcgagtctctccgtccgcaccaataatgataaataaattatatagttaatgcttatcgggacaaattagtgccacaaaacataagtcgtctgcttttcagcgggcggcttttttatctgcctatatgtttcaacacgcagaacggtacataaagtgccgccatttgttccgcaccgaatcggaaacgggtgcttccgcacgcaatcagattcaccacccctaatgccggggtttcaaccggaaagaagaaaatattgattttgatgatggcatcaaaaaaccccttccgctcgtctgccaaaaggaatggttaagaaaagcaatgcgtcttttgatggaacgcgatatataaggaattgaggggaagggcaggcgggtttctgcccgttaatcctgcggacggtcccgccaaacccgacacgcgcgggcatatggcggactgtttacaatattgtctaaaaatctgaacctgcaaacgtgaaataaggtagaatacgccccgttattttaccgtccaatccccatttaccaaggaaaaacgatgagtacttcattgagttaccgcgatgcaggtgtcgatatcgacgcaggcgaccaactggtcgaaaacatcaaaccgtttgccaaacgcacgatgcgcccggaagtattgggggatttgggcggttttggcgcattggtcgaaatcggcaagaaatatcaaaatcccgtattggtcagcggtacggacggcgtgggtaccaagctcaagcttgcctttgattgggataaacatgatacggtcggcatcgaccttgttgcaatgagtgtcaacgatattttggttcaaggggctgagcccttgtttttcttggactattttgcctgcggtaaattggatgttccgcgcgcgaccgatgttattaaaggcattgcccaaggttgcgaagaatccggttgcgccctgattggcggggaaactgccgaaatgccgggtatgtatcccgtcggagaatacgatttggcgggttttgccgtcggcgtggtggaaaaagagaatgtcattaccggccgcagcatcggcgtaggcgatgtggtattgggtttggcttccaacggcgcacattcaaacggctattcccttatccgtaaaatcatcgaacgcgacaatcccgatctggatgccgagtttgataatggcaaaaccttgcgggaggctgttattgcgccgacccgtctgtatgtgaaaccgattcttgccgctttggaaaaatttaccattaaaggtatggcacacattaccggcggcggcattaccgaaaacgtgccgcgcgtgttgcctgaaaacacggttgcacaaatcgatgctaaatcgtgggaattgcccaagctcttccaatggcttcaaaaggcgggcaatgtggaaacccaagaaatgtaccgaacctttaactgcggcatcggcatggtcgttattgttgctgccgaagatgccgatgcggttcagggtctcttgggtgaacaaggtgaaacagtttaccgtttaggtttgatccgtgagcgtcagggagacgagcatcaaacccaggttgcctgattgcttctatagcgaaatgccgtctcaaacatgggtttggacggcatttttatagaggatggcggattcgcatttgaagtgcaactttccctaacagaaaaaggccagtatgcggtagcatacggcctttcctgcaagaaagattgccatgagctacacgcaactgacccagggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccggactatcaaacagcgtaagcgacaaccctataagctcgattcgcagctgattcagcacatcgacaccctttatccgccgcaaactcagtcccgaacaagtatgcgcctacctgtgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaatcccgtatcggcgattgggaagccgacaccattgtcggcaaaggacagaaaagcgcattattgaccttggtcgaacgcgttacccgctacaccatcatctgcaaattggatagcctcaaagccgaagacactgcccgggcagctgttagggcattaaaggcacataaagacagggtgcacaccattaccatggataacggcaaagagttctaccaacacaccaaaataaccaaagcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaaggattaacaaaaatcaggacaaggcgacgaagccgcagacagtacagatagtacggcaaggcgaggcaacgccgtaccggtttttgttaatccactatatattgattgatatgagggtgggttacacatgcttaaacgatataagccattgtatatttatgggattcggaatggaacattttaccctgcattagtatttccgctttttattatgccgtctgaaaatatcatgatgatgcgttttcagacggcatagctgatattgcagtatcagataggggcaaacggaaaacactaaaccgaacaatattactgctatgccaagcgtacttatgggggcataaacttacatgcttggtctgttatccgaatgaccgtacggggattaaaacccctaatatgccgtctgaacgcctattccggcacaggttgggggacgttgtgccggatggcgtaaacggcggcctgcacccggctgctgaggttgagtttgcggagcaggttttgaacgtggactttgacggtggattcggcaagatcgaggtggcgggcgatgattttgttgctgtgtcctgcggcgagatagcccaagatttccagttcacgaggggtaagtgaggagagtgcctgcgtcccttgggcaggttggggggaaatcaggcttttgacgagtttggcggtcatctcgggcgagaatacattatcgccttcagcggctttgcgtatgctttcgagcagaaagtcggcgttgatgtttttcagcaggtagccgcgcgcgccgatgcgcatacattcggtcaaatcgtcgctgtcttcggaaacggtcagcataatcactgcctgctgcggattgatgctgatgatttgggagagtgcttcgcgtccgttcataccgggcatatcaaggtcaagcaggacgacatcgggttgcagccgactgatcattttgatacccgagaggccgtctgcggcttcgccgatgacttcaaaaccgtgttggcgcgacaaaagggctttaatgccgctgcggaagagggtatggtcgtctatcagaataattttaatagtcatttcaagctttcttcagatgcaaccgtcaatgagacggtggttccctgttgagcttgggaacggatttctaaaacggcatggatgcgtttggcacgctcctgcatgatgtgcagtccgacatggctgcccgtgggttctcctattttctccgtgtcgaaaccttgtccgttgtcttggatggtcatggtaaagcgtccgccgtgttcggaaagggtgaattttacatgggtggcgcgggcgtgtttgcggatgttggacaggctttcctgcaggataaaaatcatttggagctgcgcttcctgaggcggcaggaacgaaccgttttcccaggcggtttcgaccgttatcccggtttgttgcgtaaagcgggcgaataggtcggcaacggcttcgggaaattctttattgctgattttggtacggaagttgagcagcagttcgcggacatcttcataacattcctgcacgcctgttttgataaagctgatgttttctgcggcttcctcccgtttgttttcggcaaaggcggtttccagcatctgtacctgtaggtttaggaacgttaatgcttgtgcgatgctgtcatgtaatccttgcgcaatcaggttgcgttcctgcaatactgcaagcaggcgtttttcttcctcctgttttgcgccggcaagcgatacgcccaattgcctgcctagtgtttgaagcaggatgcggtcgtcttcatcaagagaaatgccgtttggaaagctgagcaacagcctgcccaatgtttcgttctggtactcaatggggaagatttcctcatggtacttccccaaatccgaagctgctgtgccgcaatccgcatgatgaatggaaacataaacatcggatccgccgtccaaacaaactctgccggaatctgctcctacggcgggcaggatacggtttagaaaatgttctgcagcctgttgcggtatgtaggattggtgcaggtcccgtgtagtttggtacagcagggtcaggttttgattttgtttttcgagactgcgtgtctgctcggcgacttgtccttccaaatcatcatataaaattttcaacctgccgcccatttgattgaaacaacgcccgacctgtttgaattccggcgtaccgccttcgggaaccggaatatcgaaacacctccgtccgatgcgttccgcaccttcccttaacgcctgcagcggccggataacccaaatctggtgccaaaacagcatcagtacagacgacaccagcgtcatcaacataattgcccattgaaaacgcctgagccaccatgtgtttttttcgttggcattttccaatgcctgcaaaaacagttcgatgtttccggcaaagcggtagagatcgacctgagtcggtcgccggtaggactggagcggggggaggatgtgtgcctgccaatctataatcagcatggattgtatcaaatcataagcaagaggggtgtccgaaggaatcagcggatggatggcatcgctttgggcaatgcgttttaaacttttttcaaattcggcaacctgattgtcaatttgcgcacggggcgagccttcacccgccatgtatgccagacggtatgcctgcattctcaagttgcccgcctcttcgatgacggaggccgcgttttccagacgcaaagagagcagcagtgtcaaaacgacagacaatgccgccaacccgacccacagtccggtcaggagtttcaggcgcagggaaaggctgatgccgtctgaaaaacgggctggcagtatcatgctcggcgaaaaattgttccaaataatgcaaacaatatcattctttggaattagatacaactgctcagaaagaattggttaaggaaaacttaatccgcaccgcttcagtgttaaatcatgttatgataaaattcagataatatgaatttatttgccgtctgcttcagacggcattttgagtcattgggaacggcagactgcaatcatgaaaacctcgaacttttccaagagaacatccgcaatgaaaacttttgccctgatactggccggcggtcaggcgagccgtatgggaggcgaggacaaagggcttgctcttttgggggtaaggcactgatagaccatgtcatcgacagggtcaggccgcaggtcagccatatcgccatcagcaccaaccggaatttggaagaatatgctcgaagaagtccgcatatttttcccgatgcgcggcagtggcagcatttcggcccgctttcggcattgtgtaccgcagccaacgatttgcagttggcggctgctgactggcttttggttgtgccgtgcgatatgccgtatctgccggacgatttggtggcgaggtttgaaaccgtgtcgaaacgcacaccgttgtgcaatgcgtattatgtggaaacgccgataacgatgcactacaacattatgtatatccgcccgcagattctgcaaagcgcgattccctatctgttttcgggtatgaaaacattaagaagctggttgcagcagcaaagggcgcggccggtcagattcgagtttgacgggcattttgccgacttgaacacgcaaatcgatttgcaggagggataagggcaagaccgccgaccggcgtggaaaggaaaggtcaagccataccgggcggtttttgcccgaatcggaggcataatgctgtctgaaggcatttcagacggcatttttcgcggggagatgctacaatttgcaccatttttaccgacacagggaaacaggattatgtttacaggcattgttcaaggattgggaaaactgacggcaatccaccgcccgtcggaggcatttcacacttatgtcgtcgagcttccgcaagaggcggcggacaatctgcaacgcggcgcatcggtcgccaataacggctgctgcctgacgattaccgaaatcgaaggaaaccgcgtcagtttcgatttaatggcggaaactttggcaaaaaccaatttggggctgctgaaggaaggcgattgcgtcaacatcgaacgggcggcgcgtttcggagacgaaatcggcggacacgtcatgagcggacacattatggcaaccgtgcctattgtcgaaatcgaacgggacgggttcaaccgcacggtttggttttcgctcccgcatgaactcaaaccctatatcctgaccaaagggttcgtcggcttggacggttgcagcctgaccataggcaaagtcgaagacggccgtttcaatgtccatctgattcccgaaactttggaacggacgctgttcggcagcagaaaggtcggcgacaggatcaacatcgaaatcgatccgaatacgcaggcaatcgtcgataccgtcgaacggctgatggcgcaaagatatgcaaagtgaggcagagatggaattgaacgaatttctcgataaagcctatgccgttttgcggcgtttggatgccgtgcttccgcccgaacccgggcatacggattggaacgcgcttgccttccgctggcagagtgcgggcaaaaaaggttttttggaacacttgcccgatccgcacacctttcccttggtaaggctggcgggagtcggcaggcaaaccgaattgctggtgcgtaataccgaacagttcattgtcggcagacccgcgaacaatgtattgatgagcggcgcgcgcggaacaggcaaatcctcgctggtcaaagccctgctacacgaatatgcggataagggattgcgcctgatcgaagtcgataaaagcgatttaatcggcctgccttacctgttgacgcttttgaaggaatgtccggaaaaatttatcgtattttgcgacgatttgtcgtttgaaagcggcgatgaaacctataaggcattgaaaaccgcgttagacggcggtctgtctcaacgttgcgccaacgttttggtttacgcgacttccaacagacggcacctgatgcccgaatattttgacgagaatgccggtacgacggggatgcggggggaaatccatcagaaagaagcggtggaagaaaaaatatccctgtccgaccgattcggattgtggctcagtttttatccgttcgatcaaaacgattatctggcggcggtgcaaaattggctggaagatttcggcgtgccgtatgatgaaaccgcacagatggcggcattgcagtgggcgcagacgcggggcagccgttcgggacgttccgcgtggcagtttgcctgcgactgggcgggcaggctgccgaaacaacgggcgttgtgagcgtttcggggattatttgaggcaggaagaaagccacatttgctgctgttgcggtgtgaggatatggaagaaccggtgttggatttccaattcgtccaccgcaaaatccataccggacaaatagcggctttcgacataatcgcgcgcctcgttccgattaaaaacatccgaggaaatgatttcgacgacagaccggcggcggctgtgttcggaatgcataaccttcaaacgcgccctgtcgcccgccattttgaaggcggtgcggattttacgcagctcattgtgctgactttgggtcagcccgagtcggcgtatgtcgcagttcggttgaaaatcgttcggggggatataagccgtggcggcgtgggaaagctgacaggaaagcaaagccatacttaaaaaagaggcggcaggtttggcaaaacggcagggagcaggcagtggcacggcttttcctcttgttggaaattttaggaaatatactagattgacgtgtgaaagatggtattatcgcggttaacttttgttaataatgcgtacgtatgtccggcaggcagacataacggcggaatcggaacgtatagtggattaacaaaaaccagtacagcgttgcctcgccttagctcaaagagaacgattctctaaggtgctgaagcaccaagtgaatcggttccgtactatctgtactgtctgcggcttcgtcgccttgtcctgatttttgttaatccactataaaaggatattgaaggaaaaaacatgactacttaccgtatcgcacccagcattttatcggcagactttgcccgcctcggagaagaggtggaaagcgtcattgcggcaggtgcagatctgatccattttgacgtgatggacaaccattatgtgccgaacctgaccttcggccctatggtttgcgcggcgttgaagccttatgcaagcgtgccgattgatgtgcatctgatggtcgaacccgttgacgacctgattcagtcgtttgccaaagcaggagcatcaatcatcacgttccatcccgaggcgagccgccatatcgaccgcagcttgagcctgattcgtgatatgggctgtcaggcggggctggtgttgaatccggcaacgcccgtatatctgttggaaaacgtattggacaggctggatatggttttgctgatgtcggtcaaccccggattcggcggacaaagcttcatcccgcacacccttgaaaaaatccgccgggtgcgggcgatgctggatcggtacgaagcacaaagcgggcggcacatcgccatcgaagtggacggcggcatcaaaaccgacaatattgccgccgttgcccgagctggtgcggatacctttgttgccggttctgcgattttcggcaaaccagactataaggcggtgattgatgcgatgagggcggaactggaaaaaagcggcaggctgaaccttgcgccaatgattgaaatagaaatgccgtctgaaaattagctctgtttcagacggcattgcgttatttttcgacgggcagcccgaaatgcaggtaggcgcgttcggtcgccatcctgccgcgcggggtgcgttgcaggaagccttgttggataaggtagggttcgataacgtcttcgatggtgtctgtagattcgccgatggcggcggcaacattgtccaaaccgaccgggccgccgccgaatttgtgcaaaacggcttcgagaaatttcctgtccatcacgtccagcccctgcgcgtccacgtccagcatacttaaagcggcatcggcgatgccgccgtcgattgtgccgttgtttttcacgtcggcgaaatcgcgcacgcgtcgcaacaggcggttggcgatgcgcggcgtaccgcggctgcgtttggcgatttcttccgcgccttcttcggacatatcgagctgcaacagttgtgccgaacggctgacgatggtggtaaggtctcggttttcgtaaaactcaaggcgggagacgatgccgaagcggtcgcgcaacggattggtcagcataccggcgcgggtggtcgcgccgatgagcgtgaagggcggcaggtcgattttgacggaacgggcggcgggtccttcgcctatcataatgtcgagccggtagtcttcgagcgcgggatagaggatttcttcgacaacagggctgaggcggtggatttcgtcgatgaacaatacatcgtgcggatcaaggttggtcaaaagggcggcgaggtcgcctgcgcgttcgaggacggggccgctggtttggcgcaaatttacgcccaattctttggcgatgatgtgcgccagtgtggttttgcccagtccgggcgggccgaagagcaaaacgtggtcgagtgcttcgccgcgttttttggcggcttggatgaaaatggcaagctgttctttggctttgtcttgcccgatgtagtcgtccagcgttttggggcggagggcgcgttcgagcagttcttcctgtgcggaggcggtttgggcggcaacgatgcgttgcggttgcgcggcggtcaggttgtcggtttgcagcatagtgttccctttgtcgggtatgccgtccgaacggtcggcggcgtttcagacggcattgaaaagataacggtcaaaagcgttttatccgcgggtttcgcgccaaacgagatagtcgcgcaggggcggcataggcgggttgatgcagtgggggcagatgccggtggtgtcttcgtcgtcgctgtcgatgtggtaggcgttggggtcgaagcggatttgctgcatgacggcttgcgccaatgcctgcgcctgaacaacgtcgaaattgaatttttcgaggatttcgttcaacaggcggatttcgccaccgctaaattccgcactgtgtttgaggatgaggcgttgataatcttcgttgttgattttaggcaataaatcggttttcagggtcatgattttatgtcgggggcggaatggctgaagcgtgaattatagcggatatggcggcggctgttgcaaagcttggattgggtatcgtcctcaaaactttatagtggattaacaaaaaccagtacagcgttgcctcgccttgccgtactatctgtactgtctgcggcttcgtcgccttgtcctgatttttgttaatccactataaaagtggctgcattggacgttttaatgtttttctgttttgtcttgcgccgctcgaaacgctttttgcaatggggcgatttgtgccagccgcgcccggtcgatttgttcggcgataaggtgcgcttttccctgtgcgcggcattcggcggcgattttgcccgaatccgcctgattggcggcttcgagtaaggcgagccagtgcgcgcgttgcgggtagggcgtgtgttcgcggttcagacggccttgcgtgtcggcaatgcagacgttcaatgccgtctgaaagcgttcgggtcgtctgaaagcgtcggtttttttcaaaacgttcagaatggtttggcttttaagctgtccgacttggtggaaaataatgtgccaacggcaaaccaattcggcaagctcggcgcaatgtttcggcgcacgcagccgctgattgacttcgcgcacgggttcgacaccggcgaggtcgtgtccgtggtggcgcggcaggatgtcggacggtgttttggctttgcccaagtcgtgcagcagggcggcatagcgttcgggcaggctcaagcccatatcggcggcgcgttgcagcgtcatcagggtatggatgccgctgtcgatttcgggatggtagtcggcgcgttgcggcacgccgaagagggcattgacttcgggcagcaagactttgagcgcgccgcattcgcgcaacacttcaatcattttgcgcggatttttttccatcaaacctttcgcaaactcctgccagacgcgttcggcaaccaatgcgtccgcttcgccgttttccaccatctgccgcatcagctttatggtttcttcggcgatttcaaacttgtaacgcgcggcaaagcgggcagtacgcaggatgcggacggggtcttcggcaaaggctggggaaacgtggcgcaaaatgcctgccgccaaatcccgttgtccgccgaaagggtcgataatcttgccgtccgcatcttgcgccatcgcgttgatggtcaggtcgcggcgcatcaaatcctgctccagcgtaacgtctttgtcggcgtggaaactgaaaccgacgtaacctttggcggttttgcgctcggtgcgggcgagggcgtattcttcgtgtgtttcgggatggagaaacacgggaaaatctttgccgaccggctggaagccttgcgccagcatggtttgtgcgtctgcgccgacgaccacccaatcgcggtctttgacgggcaagcccaaaagataatcgcggacggcaccgccgacgagataagtctgcatatgcttcctattttaaagttatcaacaatgccgtctgaagcggcttcagacggcattgttccaaccggcggttatgctacgccttttttctccaagtaactttcgtaatcgcccaagtagtgttcatatccgcctttgccgtccagttcgatgatttgggttgccaaggaggaaacgaactgacggtcgtgggagacaaaaatcagcgtgccgttgtatttttccagtgccatgttcaaggattcgatgctttccatgtccatatggttggtcggttcgtccatgactaagacattgggtttcaacagcaacagtttgccgtaaagcatacggcctttttcaccaccggagagaaccttcacttttttcacgacatcgttactgccgaagagcaaacgccccaaagtgccgcggatgacttgttcgtcgtcgccttcctgcccccattggcgcatccattcgctcaggtccatatcgacgtcgaagtcgttttcatggtcttgcggatagtagccgacactggctttttccgcccatttgatggtgccttcgtccggcaacaggccgtctgaatattcggggttgtacgcgccggccaagagtttcagcagggtggatttgcccgcgccgttcgggccgatgatggcgaggcgttgtcccgcttcaaggatgaagttcaggtttttaaacaactgggtttcaaagcgtttcgccagtttttcaacttccacagcctgacggtgcagcttggctttttcatcggcttcaaaacggatatacgggttttgacgggtggaaggtttgacttcgaccatctccgatttgattttgtcggcctgtttcagacggctggttgcctgacgggctttggatttgttggcagagaagcgggcgacgaactcttgcagctcttgcagtttctctttggctttggcattgtctttcagggcgcgttcgcgcgattgggcggaggcgagcatgtagtcgtcgtagttgcccggatagatggtgatggtgttgtagtccaaatccgccatatgcgtgcagacttcgttcaaaaagtggcggtcgtggctgatgataatcatcgtggagtcgtattggttcaacacgccttccaaccagcggatggtattaatgtccaagttattggtcggttcgtccaagagcaatacatccggcttggagaacagcgcctgcgccagcaatacgcgcagtttgaagcccggggcgacttccgccattttcgcattgtgcaaatcttcggaaatgcccacgccgctcaacagttcggcggcacgcgcttcggcggtgtagccgtcgtattcggcgaacttggcttccagttcggcggctttcatgtagtcgtcttcggtggcttcgggattggcgtaaatcgcatcacgttcggtcatcgccgcccacatttcggtatgccccatcatcaccacgtccagcacgcgcatgtcttcgtaggcaaactggtcttggcgcaatttacccaaacgcacgccgttttcaatcgccacttcgccggccgtctgttccaaatcgccgccgaggattttcatgaaggtggatttgcctgagccgttggcgccgatcaagccgtaacggttgccttcgccgaatttgacggatacgttttcaaacagcggctttgcgccgaactgcatggtgatgccgttggtagaaatcatgattggtaaagcctttattgaacaagagattaaatttttcgaattttcggattgtaacataaccgccccgccgtctgaaacagacgggcaaattttcagacacttatagtaaaatatccgttttattatttcagacaaaaggtttccaaatgatagtccttcacggcatcccaaattgcgatacggtcaaaaaagccaaaaaccggcttgccggatacggcttggagtttgaatttcgggattttaaaaaacagaggccgtctgaagcggaaatctgctcgtggctggaacaagtgcctttggcaaccctgctcaacaaacgcgggacaagctggcgcaaactcgatgccgaaacacagcaaaaagtgctgtcctcgacggcggaggccgtcaaactgatgtccgaaatgccgagcctgatcaagcgtcccgtattggagtgcggcggcaaggtttacgccggcttcagcgaagaaacctacgacggcatcttcaaccggcaagccccgtgcagacagggataaaaaccgttacaatacccgacttgaatttcccgttcccattctatatcccgatttaaaatatgttccattccatcgaaaaatacagaacgcccgcccaagtccttttgggcctgattgcattaaccttcgtcggcttcggggtcagcacggtatcccatccgggtgccgactacatcgtccaagtgggcgacgaaaaaatcagcgaccactccatcaacaacgccatacagaacgaacaggcggacggcggcggcccttcgcgcgacgcggtgttccaatccctgctgcaacgcgcctacctgaaacagggcgcgaagctgatgggcatttcggtttcttccgaacaaatcaagcaaattatcgtggacgatcccaatttccacgacgcaaacggcaaattcgaccacgcgcttttaaaccgctacctttcccaacgccatatgtctgaagaccagtttgtcgaagaaatccgcgatcagtttgccttgcagaatttggtaaacctcgtccaaaacggcgtattggtcggcgacgcgcaggcggaacagctgatcaggctgacacaggtcaaccgcaccatccgttcgcacactttcaaccccgacgagttcatcgcccaagtcaaagtgtctgaagccgatttgcagaaattttataatgcgaacaaaaaagactatctgctgccgcaggcggtcaaattggaatatgtcgccttgaatctgaaggattttgcagacaagcagaccgtcagtgaaacggaagtgaaaaatgcatttgaagagcgcgtggcgcgtttgccggcaaatgaagccaaaccttctttcgagcaggaaaaagccgccgtcgaaaacgaattgaaaatgaaaaaggcggttgccgacttcaacaaggcaaaagaaaaattgggcgacgatgcgttcaaccatccttcctcgcttgccgaagccgccaaaaacagcggtttgaaagtcgaaacccaagaaacttggctgagtaggcaggacgcgcaaatgtccggtatgcccgaaaacctgatcaatgccgtattcagcgacgacgtattgaagaaaaaacacaattccgaagtgctgaccatcaacagcgaaaccgcgtgggtcgtccgcgccaaagaagtccgcgaagagaaaaccctgccgtttgccgaagccaaagacgcggtacgtcaggcttatatccgtaccgaagccgccaaacttgccgaaaacaaggcaaaagacgtgcttacccaactgaacggcggcaaggctgttgacgtgaaatggtcggaagtgtccgttttgggcgcacagcaggcaaggcagtccatgccgcccgaggcttatgcggaactgctgaaagcaaaaccggcaaacggcaaacccgcctacgtcaggctgatcggtctgccggcacccgtgattgtcgaagtacaggctgtaaccccgccggatgatatcgccgcacagcttccgcttgcaaaacaggctttggcgcaacagcagtctgccaatactttcgacttgttgatacgttatttcaacggcaaaatcaaacagaccaaaggagcgcaatcggtcgacaacggcgacggtcagtaattgacacttttgttgacaaaataacggtcggaatattccggccgttttcccatacggcggaatatgatgagccacaaaaaacaagatgccttccaaggattgatcgacgcgctgaaggttttacccaacgtcgggccgaaatcggcacagcggatagcgtatcatttgctccaacacaagcgcaaagaggctgaaaaactggtggatgccttgcagacggcattgaagcaggtttaccattgcgcgatgtgcaacacgttttgcgaaggcggattgtgcgatatttgtgccgatgaaacacgcgacgggcggcggctgatggtggtgcatatgcctgccgacgtgtcgaatatggaagcggcaaactgccacgacgggctgtatttcgtcctgatggggcaaatcaatacggcattgggaatggacgtatccgccatcgcattggacaggctggcgcaacggctgggcggcggggaagtcgaagaaatcattattgcaaccgcttttaccgcagaaggcaatgcgacggcgtatgtcctgtccgagttttttaaaaacctgccttacaaagtcagcaggctgtcgcagggcattcccttgggcggcgaattggaatatgtcgatgcgggaacgctggcgcaggcggtgtacgaacgccgcctgattaaagaaggcggggcataacgccgccaatgcaaaatgccgtctgaagccttcagacggcatttttccgggcggtttacttgcagtttagcccttgaatctgcaatgcgcctccgttgccgactttgaacacgcactgcgtcgcgctgctgccggacacggtaatgctgccgctgccgccgttcaggctgataggttccttaacacccataccgactgccgttgccgccagcttttgcgcgtcggcttcggaataaggcgtgttgttggcatcgattttgatttctttggcgtaggcagccgcagcggcggataaggcgatggcgcacaaagcaaaagcagttcggatattcattgttttcctcaagaaacggtttttctgaaggaaaggatagggcagtttgacgcgttgtgcaagttttccgcccgctctgccgccccgtcccccgcactcgggcgttcggacgctgcctgggttttacggtacaataaacttttgccgccgcccccaaaccgccgtccggggcggcacgtttgcagacatttttaaggtagcgttatgttttctctagaggcttggataggcttgaggtatctcagggcgaaaaagcgcaacggctttatgtcgtttatcacgatggtttcgattgccggaatcgccttgggcgtaaccgcgctgattgtcgtcttgtcggttatgaacggctttcagaaagaaatacgcgggcagctcctgaatgtcgcgccgcacgccgaaatcggctatatcgataatacggatacggattggcgcaacctgcttcggtttaccgaaaaccgcaaaggtattttggctgccgcgccctatgtttccaatcaggcattgctggccaatgcgggcgaaatcaggggcgtgcagatgcgcggcattttgccgtctgaagaacgcaaagtggtggaatacggcgacaaaatgccggcaggcaaatttgaagatctgattccgggcgagtttgacattatcctcggtgtcggcttggcggaggctttgggggcggaagtcggcaataaagttaccgtcatcacgccggagggcaatgttacgcccgccggagtcgtaccgaggttgaaacagtttaccgtggtcggtctggttaagacgggcgtttacgaagtggacaactcattggcaatgacgcatatccaagacgcgcgcgtgctgtaccgtttggataaggaagttgcggggctgcggctgaagctcgccgatccgcaaaacgctcccgccttgacggcaacactgattccggaggcgcaaagggacgcggtttgggtgcgcgattggacgtacagcaaccgcagctattttgaagcggtcgaactggaaaaacggatgatgttcatcatcctgacgctgattatcgctgtggcggcgttcaaccttgtctcttccctggtgatggcggttacggaaaagcaggcggacattgcgattttgcggactttgggtctttcccctgctggcgtgatgaagatttttatggtgcagggcgcgttttcaggctttttcggcacgctggcgggtgtggtctgcggcgtgcttttgggttggaacgtcggcagggtcgtggcgttttttgaaaacctgctcggtgtccacctcatcaattcgcaggtttattttatcgactacctgcccagcgatgtcgatatgggcgacgttgccctgattgcctgcatttctttgggactgtctttcgttgccacgctctacccgagccggcgcgcgtcaaaaacccaaccggcggaggctttgcgttatgagtgagttgattttgaaatgcgaaggcgtgggcaaacgctatcgggacggcggtttggacgttcgggtgctgcacggcttggatttggaaatccacgcaggggaaagcaccggcatcatcggttcttcgggcagcggcaaatcgacgctgctgcatattttgggcgggctggatatgccgtctgaaggcagggtgctgctgatgggcgaggatttgcgtaccttaaaccagcggcgtttgggcgatttacgtaaccgccatctcggtttcgtgtaccagttccaccatcttctgcctgaattttcggcactggaaaatgtgatgatgccgcttctgatcggcaaaaaaagccgtgaagaggctgcggaggcggcaatggcgatgctggaaaaggtcggactgaaacaccgttcgacgcaccgcgcgggcgaactttcaggcggtgagcggcagcgtgccgccattgcacgcgccttggttacccaacccaaatgcctgcttgccgacgaaccgaccggcaatctcgatcgtgcgaacgccaggaatgttttggatatgatgctggaactgaaaacagaattgggaacggggctggtggtcgtaacgcacgacgacgaactcgccggccgcttcgagcgcgtgatggtcatgaaagacggcagcctgcaccccaaacagggcgcaaacgcctaaacagccgaaacaacaccgcgccgtctgaagccccacgccttcagacggcatttggataaggaataaaatggaacggcagacagatgaatttgcccaagcggcggcaagggcggcaatccgttttttggaacactatgcgggttccggcgacgaagtgcttgcaaactgcaccgaacgcctgtttcaggcattgcaaaacggtcattcgtttatccgtttgagcggtggcgaggctgacgcgctgtcggcactcgcacccgttgtcggaacatccgccgcgcctttgattttggaaggcagaaggctgtttttgggcaggatgtggcagttggaatacgatttggctgccgagataaaacgcttggcggcagccggcacatccgcccccgacgcggcaggcgcgaggcaaaacctcgcaaaatggtttcaaggcacgggcagcgaagggcagcgcgatgccgccgccttggcactgttgcagtcttttatggtgattaccggcgggccgggaacgggcaaaacgacaacggttgccaaactgctggcgctgatttgcggtgaagacgaaaatcttcccaacatcgcgcttgccgcaccgacgggcaaagcggcggcacatatggcgcgcgcgctgcaccgtgcaatcaacggttttgacgcgccggaggccgtccgccgccatttgctcaaactggaagggcaaaccgtccaccgactgctgaagctgcgcccgcccaaaatgcaggcggcgttcaaccctgtttacccgctgccgtttgacgtattggttatcgatgaagcctctatgctggatacggcattgatgctgcaacttttaaaagcggtcaaaaccggcgcgcgcgtgattctgctgggggatgaaaaccagctcccgtccgtcggaataggggcggtgctgtccgttttgtcacaaaaaaccgttttggacggagaaacgcaccaaaggctggccggcttccttccggaacacggtttcagcgtcagcgcaaatccacccgtgttggcgcaaaacaccgcccatctgtcgttcagccaccgcttcggcgacaacagcggcatcggctgccttgcccgtgccgccgtatcgggcgatgaaggggcgtgggcattgtttgaccggtttccggacgaactggaacattcggaatgcagtccgaacgctcgagtcgaaaggttgtaccgggcacacaaagcctattggcaggcggtaaaagacggcaatatcgaagccgcatacgcgggcatttcggatatcgtggttctcctccttgcatcgggatgccgattttaccgcgttcaacccaaagcggaaaacacaccatcagaaacggggcggcgatattgaccaccacgccgaagctggacgctaccggcacgacttccaagacgcccgcagtctgaatcacgggcaatgtaaaa

SEQ ID NO: 37841 - DNA, 13574 bp, Neisseria meningitidis
ggcaggcattttggcgtacaccgtcatccaaatctactatatgagccgggacgggcagtcattgggtaagaaaatcatgagaatccgtgtgttgaaaaccgacggccgcaatcccggttttgtcggcacggttttggtacgcgaaatcgcatggtcggttttggttgccattattgccgccgttatcggtcttgcagtawgtgacaacggagaaaacgccatcaacctgctggcattccttgccaactttgtcctgctctttatggtcaaacgcgaccgccgcacgctttacgacatactggcggatacggttgtcgtcaagctgcccaaataaacggacacggcaaaatgccgtctgaaagcctttcagacggcatttttatcttcagaaccgctcaagcatcgtgcagtgaagccgcgtgcagggtgttttccatcaatgtggcaatcgtcatcggacccacgccgccgggaacgggcgtaatcatcgccgcccgttcttttgccgtttcaaattccacgtcgccgcacaggctgccatcgtccaaaggttgatgcccacatcaataacgaccgcgccaggtttgatccattcgcctttgacaaagttcggaatgcctacgccgaccaccaaaatatcggctccggcaacctcgtctgtcagattttcggttgcgctgtggcagaccgttaccgttgcgcgcgccagcagcagttccaaagcctgcgggcggccgacgatattcgacgcgccgaccacgaccgcttttttccccttcggatcaatgccgtaagcttccaaaagcgtcatcacgcccttgggcgtacacgggcgcatcagcggcattttgaccgccagcctgccgacattgtaaggatggaagccgtccacgtccttatccggcgaaatacgttccaaaaccgcctggctgtcgaggtgcttcggcagcggtagctgaaccagaataccgtccacttcggaatcggcattcaggcggtcgaccagtgccagcagttcttcctgcgatgttgattcgggcagctcgtaagacagtgatttgatgccgcatttttggcaggcagttttcttgttgcggacataaaccgcgctggcagggtcgcctccgaccaaaaccacggccaggcaagggtgtgcagattgttctgttggcgttgcgccaccgcttcggcaaccgcctgcaggcgtttttgcgaaacttctttaccattgatcagttgtgccgacatatccgtccttttgttaaacaggtagaaaatgctgaaaattatcgcattttccgtttgtttttacagcaggatgccgaaaataaatttgccctgaaataaaatacggctgtttggacggattaaatattttttcaaatcaaaaaactatatttttcatcttggtgtcttgaaaataaatgttgacgcatctttccctgagttgtatagttcgcttcttcaagtcggggcgtagcgcagcccggttagcgcatctgctttgggagcagagggtcgtgagttcgaatcccaccgccccgaccaatcaatcagcacgaatcggcatgagcgcccgtagctcaaccggatagagcaccgaccttctaagtcgggggttacaggttcgattcctgtcgggcgtgccaagaatttgattgaaaaccgtttttatggtggctgtagctcagttggtagagccccggattgtgattccggttgtcgtgggttcgagccccatcagccaccccagataaaggcccgtacttttcggtacgggtcttttcccgtttgcgcgtactgtccgcgccgccggctttgcctttcgcatatgcttctgtatcatgtgggtttttctgtcttttatggtttttgtcggaggctttgatggttgacgcttggtctgtccctgattttgaatcgaaaatctgtccgcccgaggcgttggcggcgcgtttggcgttgttgccgcgcccgctggtgtttaccaacggctgtttcgacatcctccacagggggcacgttacttatctggcgcaggcgcgttcgatgggggacgcgttggtgctggcgttgaataccgatgcttcggtgcggcgtctgggcaagggcggtgaccgcccggttaatcctttggagaaccgtgccgccgttgccgccgctttggaaagtgtggatttggtaacgtggtttgacggggatacgccggcggcgttgattgaggcggtcaaacctgagattttggtcaagggcggcgattgggctgcggataagattgtcggtgcggcagaaacgttggcgcgcggcggtcaggtgttttcaattccgtttctgcaccagacttcgacaacgaagactttggcaaaaatccgtgcggcagagggcggaaaatgacggttttgaagctttcgcactggcgggtgttggcggagcttgccgacggtttgccgcaacacgtctcgcaactggcgcgtatggcggatatgaagccgcagcagctcaacggtttttggcagcagatgccggcgcacatacgcgggctgttgcgccaacacgacggctattggcggctggtgcgcccattggcggttttcgatgccgaaggtttgcgcgagctgggggaaaggtcgggttttcagacggcattgaagcacgagtgcgcgtccagcaacgacgagatactggaattggcgcggattgcgccggacaaggcgcacaaaaccatatgcgtgacccacctgcaaagtaagggcagggggcggcaggggcggaagtggtcgcaccgtttgggcgagtgtctgatgttcagttttggctgggtgtttgaccggccgcagtatgagttgggttcgctgtcgcctgttgcggcagtggcgtgtcggcgcgccttgtcgcgtttaggtttggatgtgcagattaagtggcccaatgatttggttgtcggacgcgacaaattgggcggcattctgattgaaacggtcaggacgggcggcaaaacggttgccgtggtcggtatcggcatcaattttgtcctgcccaaggaagtagaaaatgccgcttccgtgcaatcgctgtttcagacggcatcgcggcggggcaatgccgatgccgccgtgctgctggaaacgctgttggtggaactggacgcggtgttgttgcaatatgcgcgggacggatttgcgccttttgtggcggaatatcaggctgccaaccgcgaccacggcaaggcggtattgctgttgcgcgacggcgaaaccgtgttcgaaggcacggttaaaggcgtggacggacaaggcgttttgcacttggaaacggcagagggcaaacagacggtcgtcagcggcgaaatcagcctgcggtccgacgacaggccggtttccgtgccgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggcggatggaaatgtccgcatcgtcggttgcgctgtgtgcggagaattcaaaaaggcacaagtgcaggaacagctcgcccgaaaaatcgagtggctgccgtcttccgcacaggctttgggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcgggggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcatttacgggttgttgaacatgattgccgccgaaggcagggaatatgaacatatttaaggaatacagagatgaaatggctatttatccttttggttgcgattaatattgccgtattcggcggtacggtaggttacaaactgacactgaaacaggccggcagaataccggaggcacagaatgccgcaaacaatttgcaggttcaaccagttgccccaactatgccggttgttcggaatattccagcatccggtcctgtcgttcaggcggcatctgaatcggatacaggcgcactgctcaaacagggcgacattctgagcgaagaacaggcggagcagttgcgcttgaaaaaagaagcggaacagaaaaaactgaaagagaaaaaacagcgtgaagaaaaagcccgccgcgaaaaactcgccgccgaaaaggcgcaggcggaacgcgaaaacggcgcggcggatgccttatgcgccgcgcaggcaagcctcacgatggacgaagatgactaccaccgcatcaaaggacttttgggcaaatggtcgcacgttgccagcaggagcgtcgaaaaacgcaccgcccaagccaaacctgccgacaaaacctaccgcgtcgtcctgcccgtttccgccgatgccgaaaatcaggcggcggagctgtctgccaaaggtttcaaccccataccgtttgacggcgcattgagtttgggtgtcggcaacagccgggaaaacgcccaagccctgcaaaaccggcttgccggcgccggattcggcggggcgcatattgtcgaacactttgccgaagccgacaggcaggacgattctttgagcgtgtcgcgtatgacggttttgtttaccggcgtgaatgccgccgatgcggacgaaattcgtaaaatcacgtccctatacggcaaactgaacctcaagtcttgcaaataggcgcgaaagccggacgataaacgccaaacccaccgcgaaggtgggtttggcgtttcggttttgagtatctgatatataaaaagggaatgtatgtctcgtatatgccgactccaagtgtgaaagtgatgatggggaaatatggtgtttaatggttcggaacggacggcttccgagtggttttgattatacgctaataataataattatcaataaaaatttaaaaataaatgcagattttttgtaatacgatgaaaaataaacaaattaacctgtccgccgatgtttgtgattcgggtcggcaaactttcattgtgtcggacaaatcggggtcggcaggcatagctgagggcttcgtgcctgacggaaataaggttgcccgtgtttgaacatccgtccgatttggcgcggacagggttgtcattcgggggtgtttgagcgtggattcggggatgcgaaagcggtaaaaccgttgcggatgaaggcttacggacggctttaggtatttttaagtgtattcaaacaacaacaaaacgcttcttctattgccgtatttagggcttgcgcggcagcctgcacaccgtggaggccgagtgtttcgttggttgcggcatcgggacgggcggcaaggttttccggccggtttttccattttttccgacaaagccgtgatgccggggaatggcggtttgtccgtttcaggccgccgccgttttggaccgcgatgccgtctgaagccttcagacggcatttttgctgcctttttcaatattccgccgaatgccaaaacggttgtccgactgtcggcgtgctggcttgcgctttgtcgcgtgcttcgaccggtccggcttcaaatgccagccgtccggattcgacggcgagtgcgaaggcgcgtgccatattgaccggatcgccgctgcgggaaacggcagtattcaaaagcacgccgtcaaagccccattccatcacttgtgccgcctgtgagggcaaacccaagcccgcgtcgataatcagcggcgtgtcgggcaggcgttcgcgcaggacgttcaacgcgtaggcgtgaaccgcgcccaaacccgtgccgatcggggccgcccacggcatcaacgcctgacagcccgcgtcgagcaggcggcggcaggcaatcaggtcttcggtgcaataaggcagcactttgaagccgtctttaatcaggatttccgccgcttcgacaagctggaacacatccggctgcaaggtgtcgtcatctccgatgagttccaattttatccaatcggtttcaaacacttcgcgcgccatttgcgccgtcgttaccgcttcctgcacgctttggcagcctgccgtgttcggcaggacgggaacgccggtttcttgaagcagcgaccaaaacccctgaccgtgcgcctcgccgccgcttcccgcgcggcgcagcgagacggtaatcatcgcaggctgggcggtttggatggattgtttgaggatttcgggggtcgggtaggcagccgtgccgagcagcagccgcgaggggaaagtttcgccgtatagggtgagcataatgggttcctttgtatagtggattaacaaaaaccagtacggcgttgcctcgccttagctcaaagaaaacgattctctaaggtgctgaagcactaagtgaatcggttccgtactatccgtactgtctgcggcttcgtcgccttgtcctgatttaaagttaatccaccataacgttgttttggggacaggggtcgtctgaaaaggcaaaaccgcctagccgccgaccaccggccgcacgatatcgattttgtcgttttcgtttaaaaccgtttccgcatacgcgcctttggggacgaaaacggtgttgaccgccacggcaaagggcttttgcggcgcggtttgggcgatgaggtcggcaacggtcgtgccgtgaagttcggcgggtccgccgtttaagatgatgttcatggtttctcgatgtttctgtatttatagtggattaacaaaaaccagtacggtgttgcctcgccttagctcaaagagaacgattctctaaggtgctgaagcaccaagtgaatcggttccgtactatttgtactgtctgcggcttcgtcgccttgtcctgatttttgttaatccactatatctagccgaattactttattttttgatacgcaactgaccggttgccgtcattcccgcacgggcgggaatccatttttgaaattcggaaactgtttttcaaatgatggtttctcaagttttaaggcggattcccgcttacgcgggaatgacggaatttgatgatatgccacatttaaagttaagtatgtttgcgataacgggctaagttttgcctacacggcaattgaattttcttctttcggttttatccatcccacaaagcctgaaacgctttaaccaccgcttcgggatttgccgcttcggttacggcgcggacggcggcgagtgaggaaacgccggtggcgagtacggctcgggcgttgttcaagtcgataccgccgatggcgacgacgggcgtgccgcctgcttgtttgacgtattcgcgcagtttgtccaagccttgcggggcggtgggcatttgtttggtcgtggtcgggaaaatcgcgccgctggcgatgtagctagggtgtacggacagggcgcggtcgagttcggcaacggagtgcgtactcaaacccaagcgcaaaccggcggcggcgatggcggcaaggtcggcggtgtccatgtcttcttgtccgagatgcacgccgtacgcgcccgcttcgattgcttcgcgccagtggtcgttgatgaaaagctgcgtacggctgccctgacaggctgcggcgcagcgggcgatttcgcgtttcaattcatcgccgtgcagggccttgcagcgcagttgcaccgtgtcggcacctgctttgaccatgcgccccacccaatcggcggtggggacgacggcgtagaatttgagcggggattttaggggcgggaaggtcataaggtgtcctttcgggcggctttaatcttgtcttcggatatacgccaaaccgctttctttatcgcgttcgggcgcgtcttttccgtcaaacagtgccactgccaatctggcggcggcggcggttacggcgggggagatcatgaaaccgtggcggaaaaggccgttgatttcaatcaggcgtcgggcgcggttgtaacggatttcggggttgtggtggttgagcgtggggcgcaggccggtggcgatttcgaggatgtcggcttcgccgaaggcggggtggatggcatagagtgcggacaagagttccaaccctgaacgcacgctggcgggggcttggctttcgctttcgatttgggtcgcgccgatgacgaagacgtggttttctttcggggcgatgtagagcggataacgcggatggagcagacgcacggggcggttgagcgtgatttcgggtgtgtaaacccgcgccacttcgccgcgtatgccgcgcagggtgctggtgtgctcgggggattggttccacgcggtttttgcgccgtagccgcggcagtcgatcagccagtcgtattgggcttgcaggccttcggggacgcattcgtgttcccaatggcaggggacgttcagttcgtccaaagcgtcggcaagtgcagacaatatttgccgcccgtcgagctggccttcggtcggcaggtagatgccgtctgaaaaacgtccgccgagttgcggttcgcgttcggcgatgtcgtcggcgcgccaacggacgatttcgtcatccgctacgccgccgcgtttgagatggcggacgaactcgctggataatggcttgtcctgcccgtgccacacaatcaggctgccgttttcctgcatcatcgtgtgcgtgttcagacggcatcggatgccgcgccaaagcgggatgctctgcctgcccagcctgaccacttcgggcgtggcttcgaccgcttccgccgcaggcgcgagcatggcggcggcaacataggcggcggcgtgttcgccccggcggcagcctttatcgaaaagtgcaatctgataaccttgttctgcaagctgcaacgcggtcagccttcccgagaggccgccgccgaggatggcgatacgggtcatgacgggttcctttgtaaagattgggtttttttaaagaaaaggcgtaccgatacggtggcaatggcaacggcagacattacgggggcggtcagaccgatgctgctttcccagccggacgagagcaggaagcggtagaggatgaagcccgcaagccacagaaccagtccggcaaagtcaaagccttcaatctcctcacgccgtttcaagacgaaaaagtcggcaatcaaaaccgccgccatcggcgcaaataccgagccgataagcagcaggaagttttcatattcggtaacgggcagcatgacggcaagtaccgtgccgatcagggtaacgccgacagcgacgggtgtttccgcaaaacgcgcggaaatgttgttcgcactcgcgccggcggaataggcatcgagaaacgttgtggtaacggtggagaggacgaccgccaaaatgcctgccgcacccaaacctgcgcccagcaggatttttgccacgtcggtttctccggtgaacaacgccgctgccaaacccaaggcatacatccagcagccggtcagcgtgtaggcgagcgttgccgtcagggttgccgcaaacgggcggcgcgcgtggcgcgtgtagtcggcggcaagcggcagccaggaaagcggcatcacggcggacagctcgactgccgttccgaaactcatgccgtctgaaacctgtgcggcggtgctgcctgccgtggaaaagacttcggcactcagccacagaaccgccaacagcatcagcagcatcgaaacggttttcagcccgcctgttttgcgtgcgccgaaaaccagccacagcacaatcagcgcgccgtttgccaatgcccaccagacaaaagattcgccgtcccacaacactttgcccaaagcggagctgaccgttgcgccggcgtaaatcatcaccgccgtccagccggccagttgcagcatattcgccacggaaaacagcactgaaccgcgtttgccgaacgacaggcgcacgctttccatcgagctgcgtccggtcagtgcgccgatatacgccgccgcaaaaaacagcgcgccgccgacggcatgacccaaaagtagagccgccagaccgcgctgccagcccaaaggcgcaagcagcgtacccgtgctgatttcggcaatcgataccgccgcgccgaaccaaatcagcccgatggcggaggaagatgaaggagaggaggcattgcccgacatatcaagtccttaaaaaacatgaaaatggggcggggaagtgcggaaaagggaacggaagcctgataaggcatttgacggtttgtttcctacgcaggcattaccccgacaggttctacggattctgctttcgcaatctcagccgcccggcggcggcactccgacaaggagctttaagtgtacacaaaagcagggggcgttggcaaaaatcttacatttcaggcggcacggcgcatttctatagtggattaacaaaaatcaggacaaggcgacgaagccgcagacagtacaaatagtacggcaaggcgaggcaacaccgtactgttttttgttaatccactatataacaaatgccgtataatcaagcccctgattttttatgcgccgacactatgcatccgacctattccgccgtacaggcgcggctgctcgaagccaaccgcctttcccccgaactgctcgccaaaagcctgtgcatcatcggcgcgcaccacgtcgattacgccgacatctactgccagcgcaccgcttatgaaagctggcatttggaagagggcatcgtcaaatcgggcagcttccaaatcaatcagggcgtgggcgtgcgcgccgtttcgggcgacaaaaccgcctttgcctacgccgacagcctgtgcatcgattcgataaaccgttccgcccgcgccgtccgcgcgattggggcggcaggcggcaaggtgtccgccaaaatgccgtctgaaacgcgcggcaagccggtttgttccgcgtccgaccccattgccggcctcgattccgccgccaaagtcgcgctgttgaacaaagtggaagcaatcgccaaagccgccgatccgcgcatcgtgcaagtgatggccggtttgacctgcgaatacgatatggtttacctcgcccgtctggacggcaaacacgccgccgacatccgcccgatggtgcgcctgaacgttaccgttatcgccaaacagggcgaacgccgcgaacagggcagcgcgggcggcggcggacgctacgacttggcttatttcgatgaaaacttggttcatcggtttgtcgatgccgccgtcaaacaggcactcaccaacctcgaatcccgccccgcgcccgccggcgaaatgaccgtcgttttgggcaacggctggccgggcgtgttgctgcacgaagcggtcggacacggtttggaaggcgatttcaaccgcaagggaaccagcgtcttttccggcagaataggcgagcgcgtcgccgccaaaggcgttaccgtcgtcgatcagggtgatattgccggccggcgcggttcgctcaacatcgacgacgaaggcaacgaaacccgccgcaccgtattgattgaagacggcattttagtcggctatatgcaggacgaaaccaatgcccgcctgacgggtacgcagtccaccggcaacggccgccgcgaaagttacgcttccgcccctatgccgcgcatgaccaatacctttatggaaaacggcagctatgagccggaagaaatcatcgcgtccatcgacaagggcatttacgccgtcaactttggcggcggacaagtggacattaccagcggcaagttcgtgttcagtgcgtccgaagcgtggtgggtggaaggcggcaggctgcaatatcccgtcaaaggcgcgaccatcatcggcaacggccccgaagtgctgaaacacgtttccatgataggcaacgatactgcgctcgacagcggtgtcggcgtgtgcggcaaagaagggcagagcgtccccgtcggcgtggggcaaccgactttgcggattgatgccggactgaccgtcggcggcagcgcaatctgacgcggaatccggcacgatgccgtctgaaaggttttcaggcggccttttacattaggataaaaccatgcaggaacagaatcggaaaccaagttttcccatagtgatgttgctggtgtcggttgccctgtggatagcgtctttatccaatgttgcattttatttgggcaatcatggaagcatggagggtttgaccgttttgattttggggtcgatatttgcttctttggatatcaggtattgtgcggtctatgcgaattatgtttggttggcggccattgttttgctggcgttgcggaagaaggtcgtgcctgtccatgcggcactttggggcttggcgttggtggctttcagtgtgaaagccgtatacgtcgatgaagcagggaatacatcggatattgtgcgctacggtgcaggattttatttgtggtatgccgcatttgcggttgccaccatcggtacgtttgccggaaagaataaggaaagaaaagccgcatcagcggcagacgggataaaaatgacgtttgataaatggttgggcttgtcaaaactgcctaaaaatgaagcaagaatgctgctacaatatgtttcggaatatacgcgcgtgcagttgttgacgcggggcggggaagaaatgccggacgaagtccgacagcgggcggacaggctggcgcaacgccgtctgaacggcgagccggttgcctatattttaggtgtgcgcgaattttatggcagacgctttacagtcaatccgagcgtgctgattccgcgccccgaaaccgaacatttggtcgaagccgtattggcgcgcctgcccgaaaacgggcgcgtgtgggatttggggacgggcagcggcgcggttgccgtaaccgtcgcgctcgaacgccccgatgcgtttgtgcgcgcatccgacatcagcccgcccgcccttgaaacggcgcggaaaaatgcggcggatttgggcgcgcgggtcgaatttgcacacggttcgtggttcgacaccgatatgccgtctgaagggaaatgggacatcatcgtgtccaacccgccctatatcgaaaacggcgataaacatttgttgcaaggcgatttgcggtttgagccgcaaatcgcgctgaccgacttttcagacggcctaagctgcatccgcaccttggcgcaaggcgcgcccgaccgtttggcggaaggcggttttttattgctggaacacggtttcgatcagggcgcggcggtgcgcggcgtgttggcggagaatggtttttcaggagtggaaaccctgccggatttggcgggtttggacagggttacgctggggaagtatatgaagcatttgaaataattgtttgcaaaattggcgg

SEQ ID NO: 37842 - DNA, 17782 bp, Neisseria meningitidis
gaatcaaaaattaacttggggagcggaaatggttccgcgtcttacccgtttttaggagttcgttaagtggcaaagaaaattatcggctatattaaactgcaaattcctgcaggtaaagccaatccatctcctccggttggtcctgctttgggtcagcgcggtttgaatattatggaattttgtaaggcatttaatgctgcaacccaaggtatggagcctggcttaccgattccggttgtgattactgcatttgcagataaatcattcacatttgtgatgaaaaccccgccagcttctatcttgttgaaaaaggctgccggtttgcaaaaaggtagttctaatcctctgaccaacaaagtgggtaaattgacccgtgcccagttggaagaaattgctaaaactaaagatcctgatttgactgctgctgacttggatgcggctgtccgtactatagcaggttctgctcgctcaatgggcttggatgtggagggtgttgtataatggctaaagtatctaaacgcttgaaagctcttcgctcttctgtggaagccaataaattatatgcaattgatgaagcaattgctttggtaaaaaaagcagcgactgctaaatttgacgagtctgttgacgtatctttcaacttgggcgttgatccgcgtaaatctgaccaagttatccgtggttcggtcgttctgcctaaaggcaccggtaagataacccgtgtggctgtatttactcaaggtgcaaatgcagaagctgctaaagaagctggtgcagatatcgtcggtttcgaagatttggctgctgaaatcaaagcaggcaatctgaactttgatgtcgttattgcttctcccgatgcaatgcgtattgttggtcagttgggtactattttgggtcctcgaggcttgatgccaaaccctaaagtaggtacggttactcctaacgttgctgaagcagttaagaatgcaaaagcaggtcaagtacaataccgtacagataaagcaggtatcgttcatgcaacgattggtcgtgcttctttcgctgaagctgatttgaaagagaactttgatgcgttgctggatgctatcgttaaagccaagcctgctgccgctaaaggtcagtatctgaaaaaagttgctgtgtctagcaccatgggtttgggtattcgcgttgatacatcaagcgtaaataactaatcttaaggaattttcaagcagtttggttttctgggctgcttgaatttgggctacttaaaattaagtagatgtccaagaccgtagggatcgtaagatttaatcgtaactgccctacgcagacggtagtcctgaaacacattgcaagattgcttgtaagatgtctttttaggttaccgcgctggtgggatatcgttttggtatcctgtttataaacagtgggaggtagaccttgagtctcaatattgaaaccaagaaagtggcggtcgaggaaattagcgcggcaattgctaatgctcaaaccctcgtagtcgctgaatatcgcggtatcagtgtttccagtatgactgagcttcgtgcgaatgcacgtaaagaaggcgtttatttgcgcgttctgaaaaatactttggctcgtcgtgcagtgcaaggtacttcatttgcagaattggccgatcaaatggttggtccgttggtttacgctgcttctgaagatgctgttgctgctgctaaagtgttgcaccaattcgcgaaaaaagatgacaaaattgtcgttaaagccggttcttacaatggcgaagtaatgaatgctgctcaggttgctgagttggcttctattccgagccgcgaagagctgttgtccaaactgttgttcgttatgcaagctcctgtatcgggctttgcgcgcggtttggctgctttggcagagaaaaaagccggcgaagaagccgcttaatcgattttgtttctgttaatcaattattttttaatacaatatttggagtaaaatagcatggctattactaaagaagacattttggaagcagttggttctttgaccgtaatggaattgaacgacttggttaaagcttttgaagaaaaattcggtgtttctgctgctgctgttgcagttgcaggtcctgctggtgccggtgctgccgatgctgaagaaaaaaccgaatttgatgtcgttttggcttctgccggcgatcaaaaagtcggcgtgattaaagttgtccgtgcaattaccggtttgggtctgaaagaagctaaagacatcgttgacggcgcacctaaaaccattaaagagggtgtttctaaagctgaagccgaagacatccaaaaacaactggaagaagcaggcgctaaagtcgaaatcaaataatttgatgcttcttatgaaggctggcagttttctgccagccttattttgcttcttaaaataaacatcaagtattgtttacatttatttgcatagtttttatcaagtcattgcaaataaatgtaaatatcagattgatgcgtaccgttgtttcagacggcctattattgaaaattacttttcggagtgtgtatgaactattcgtttaccgagaaaaaacgtatccgtaagagttttgcaaagcgggaaaatgttttggaagttcctttcttgctagcaacccaaattgattcttatgcgaagtttttgcagctggaaaatgcttttgacaaacgtaccgatgacggtctgcaggcggcatttaattctattttcccgattgtgagccataacggttatgcgcgattggagtttgtgcattacacattgggcgagcctttgttcgatattcccgaatgtcagttgcgcggaatcacttatgcagcccccttgcgcgcgcgtatccgtttggtgattttggataaggaagcatctaaaccgacggtaaaagaagttcgtgaaaacgaagtgtatatgggcgaaattccgttgatgaccccgagcggttcttttgtgattaacggcacagagcgtgtgattgtctcccagttgcaccgttcgcccggcgtattcttcgagcatgacaaaggtaagacgcactcttccggcaaattgttattctccgcccgcatcattccctaccgtggttcatggttggattttgaatttgatccgaaagatttgctgtatttccgtatcgaccgccgccgtaaaatgccggtaacgattttgttgaaggctttaggctacaacaatgagcaaatcttggatattttctacgacaaagaaacgttctatttgtcttcaaacggtgttcaaaccgatttggttgcagaccgtctgaaaggcgaaactgccaaggtcgatatcttggataaagaaggcaatgtattggttgccaaaggtaagcgcattactgcgaaaaatatccgtgatattaccaatgcaggcctgacccgtttggatgtagaaccggaaagcctgctgggcaaagcattggctgccgatctgattgattcggaaaccggcgaggtattggcttctgccaatgatgaaattacagaagagttgttggccaaatttgatatcaacggcgtaaaagaaattacgaccctttatatcaatgagctggatcagggtgcttatatctccaataccttgcgtacggatgagactgccggccggcaggcggctcgtgttgcgatttaccgtatgatgcgtccgggcgaaccgcccaccgaagaggcggtcgagcaattgtttaaccgcttgttcttcagtgaagacagctacgatctgtcccgcgtaggccgtatgaaatttaatacgcgcacatacgaacaaaaactgtccgaagcccaacaaaactcttggtacggccgcctgctgaacgaaacgtttgccggtgctgccgacaaaggcggttatgtcctgagcgtcgaagatattgtcgcctcgattgcgactttggtcgagttgcgtaacggccatggcgaagtggacgatatcgatcacttgggcaaccgccgagtacgttcggtaggcgagctgactgaaaaccaattccgtagcggtttggcccgtgtggaacgtgccgtaaaagaacgtttgaatcaggcggaatcagaaaacttgatgccgcacgatttgattaatgcaaaacctgtttctgccgctattaaagaattcttcggctccagccaattgagtcagtttatggatcagaccaaccccttgtctgaagtaacccataaacgccgtgtatctgcattgggtccgggcggtttgacccgcgaacgtgcaggatttgaggtgcgggacgtgcatccgacccactacggtcgcgtatgtccgattgaaacgcctgaaggtccgaacatcggtttgatcaactcattgtccgtttatgcgcgcaccaatgattacggtttcttggaaacgccttaccgccgcgttatcgacggcaaagtaaccgaggaaatcgattacttgtctgccatcgaagaaggccgctatgtgattgcacaggcgaatgccgattggattcagatggcaatctgattggcgatttggttacctgtcgtgaaaaaggcgaaaccattatggcaacgcccgaccgcgtccaatatatggacgtggcaactggtcaagtggtatccgttgcagcatccctgattccattcttggaacatgatgacgcgaaccgcgcattgatgggtgccaacatgcaacgtcaggcagtgccttgcttgcgtcctgaaaaaccgatggtcggtaccggtatcgagcgttccgttgccgttgactctgctactgcaatcgttgcccgccgaggcggcgtggtcgagtatgtcgatgccaaccgcgttgtgatccgtgtccatgacgacgaagcgactgccggtgaagtgggtgtcgatatttacaacttggttaaattcacccgttccaaccagtctaccaatatcaatcagcgtcctgccgtcaaagccggcgatgttttgcaacgcggcgatttggtggccgacggcgcgtccaccgattttggcgaattggctttgggtcaaaatatgaccatcgccttcatgccgtggaacggttacaactacgaagactcgattctgatttccgaaaaagtggctgcggacgaccgctatacttcgattcacattgaggaattgaatgtcgttgcccgcgatactaagctgggtgcggaagacattacccgcgatattccgaacttgtccgagcgtatgcaaaaccgtttggacgaatccggtatcgtttacatcggtgcggaagtagaagccggcgatgtgttggtaggcaaggtaacgcctaaaggcgaaacccaactgacgccggaagaaaaactgctgcgcgccatcttcggtgaaaaagcatctgacgtaaaagatacttcattgcgtatgcctaccggcatgagcggtaccgttatcgacgttcaagtcttcactcgtgaaggtattcaacgcgacaaacgtgctcaatccattatcgattccgaattgaaacgctaccgtttggatttgaacgaccaattgcgtattttcgacaacgacgcattcgaccgtatcgagcgtatgattgtcggtcagaaagccaacggtggtccgatgaagctggccaaaggcagcgaaatcacgaccgaatatctggcgggtctgccgagcaggcacgattggttcgatatccgtctgaccgatgaagatttggccaagcagttggaactgattaaagtgagcctgcaacaaaaacgcgaagaagcggacgagttatacgaaatcaagaagaaaaaactgacccaaggcgacgaattgcaacccggcgtacaaaaaatggtgaaagtttttatcgccatcaaacgccgtctgcaagccggcgacaaaatggcgggccgccacggtaacaaaggcgtggtatcgcgcattctgccagtggaagacatgccttacatggcggacggccgtccggtagacatcgtactgaacccattgggcgtaccttcccgtatgaacatcggtcagattttggaagttcacttgggttgggcagcaaaaggtatcggcgagcgtatcgaccgtatgctgaaagagcaacgcaaagcaggcgagttgcgcgagttcttgaacagactctacaacggcagcggtaagaaagaagatttggatgccctgactgatgaagaaatcatcgaactggcctccaacctgcgcaaaggtgcatctttcgcctctcctgtattcgacggtgcgaaagagtctgaaatccgcgaaatgctgaacttggcttatccgagcgacgatcctgaggttgaaaaactgggcttcaacgacagtaaaacccaaatcacgctgtatgacggccgttcaggcgaagcatttgaccgcaaggttacagtaggtgtgatgcactatctgaaactgcaccacttggttgacgaaaaaatgcacgcgcgttctaccggtccgtacagtctggttacccagcagcctttgggcggtaaagcccagttcggcggccaacgtttcggcgagatggaggtttgggcattggaagcatacggcgcggcatacacgctgcaagagatgctgactgtgaagtctgacgacgtgaacggccgtaccaaaatgtacgaaaacatcgtcaaaggcgaacacaaaatcgatgccggtatgcccgagtccttcaacgtattggtcaaagagattcgctcactgggcttggatatcgatttggaacgttactaaacaaaagttttcagacggcctttcagggtcgtctgaaaaagtggtttcagaataagaatgaagcaatcggcatttaggccgtctgaaatcaaaagtaccgtttcccaatatcgaaaatccgccatgcggtaaaaatacttccttcaaggagcaaaaatgaatttgttgaacttatttaatccgttgcaaactgccggcatggaagaagagtttgatgccattaaaatcggtattgcctctcccgaaaccatccgctcatggtcttatggcgaagtcaaaaaacctgaaaccatcaactaccgtacgttcaaacctgagcgtgacggtttgttctgtgccaaaatctttggcccggtcaaagactacgaatgcttgtgcggaaaatacaaacgcttgaaatttaaaggcgtaacgtgtgaaaaatgcggcgtggaagtaaccctgtccaaagtgcgccgcgaacgcatgggtcatatcgaattggctgcgcccgtcgcacatatttggttcttaaaatccctgccttcccgcttgggtatggtgttagacatgactttgcgcgacatcgagcgcgtattgtactttgaagcatttgtggtaaccgatcccggtatgactccgctgcaacgccgccaattgctgactgaagacgattactacaacaagctggacgaatacggcgacgatttcgatgccaaaatgggtgcggaaggtatccgcgaattgctgcgtaccctgaatgtagcgggcgaaatcgaaatcctgcgccaagagttggaatcgaccggttccgacaccaaaatcaaaaaaatcgccaaacgcttgaaagtattggaagccttccatcgttccggtatgaaactggaatggatgattatggatgtgctgccggtattgccgcctgatttgcgtccgttggttccattggatggtggtcgttttgccacttccgatttgaacgatttgtaccgccgcgttattaaccgtaacaaccgtctgaaacgtctgttggaactgcatgcgcctgacatcatcgtccgcaacgaaaaacgtatgttgcaagaagcagttgactcgctgttggataacggccgtcgcggtaaagccatgaccggcgccaacaaacgcccgctgaaatcattggcagacatgattaaaggtaaaggcggtcgcttccgtcaaaacctgttgggcaaacgtgtggactactccggccgttccgtgattaccgtaggcccgtacctgcgtctgcaccaatgcggtttgccgaaaaaaatggctttggaactgttcaaaccgttcattttccacaaattggaaaaacaaggtttggcctctaccgttaaagcagcgaaaaaattggtagagcaagaagtaccggaagtatgggacatcttggaagaagtcatccgcgaacatccgattatgctgaaccgtgcgccgaccctgcaccgtttgggtattcaagcgttcgaacctatcttgattgaaggtaaagcgattcagttgcacccattggtgtgtgctgcgttcaacgccgactttgacggcgaccaaatggcggtacacgttccattgagcttggaagcacaaatggaagcacgcacgctgatgctggcttcaaacaacgtattgtctccggccaacggcgaaccgattatcgtaccttcccaagacatcgtattgggcctgtactatatgactcgcgatcgtatcaatgccaaaggcgaaggcagcctgtttgccgatgtgaaagaagtgcatcgcgcataccataccaaacaggtcgagctgggtacgaaaatcaccgtacgtctgcgcgaatgggtgaaaaacgaagcaggtgagtttgagcctgtcgttaaccgttacgaaacaaccgtcggccgtgcattgttgagcgaaatcctgccgaaaggcctgccgtttgaatatgtcaacaaagcgttgaagaaaaaagaaatttctaaactgattaacgcatcgttccgcctgtgcggcttgcgcgatacggttatctttgctgaccacctgatgtacaccggtttcggatttgcggcaaaaggcggtatttccattgccgttgacgatatggaaattccaaaagaaaaagcggccttgctggctgaagccaatgccgaggttaaagaaatcgaagaccaataccgtcaaggtttggttaccaacggcgaacgctacaacaaggtggtcgatatttggggtcgtgccggcgataagattgctaaagcgatgatggacaacttgtccaaacaaaaagttatcgaccgtgccggcaacgaagtcgatcaagagtcattcaactccatttatatgatggcggactccggtgcccgtggttctgcagctcagattaaacagttgtccggtatgcgtggcttgatggcaaaacctgacggctcgattattgaaacgccgattacctcaaacttccgtgaaggtctgaccgtattgcaatactttattgcgacccacggtgcgcgtaagggtttggcggataccgcattgaaaaccgcgaactccggttacctgactcgtcgtctggtagacgtaactcaagatttggtcgttgttgaagacgattgcggtacttcagacggctttgtcatgaaggcagtggtacaaggcggtgatgtgattgaagcattgcgcgatcgtattttgggtcgtgttaccgcgtctgacgttgtcgatccgtcaagtggcgaaaccttggttgaagccggtacgttgctgactgaaaaactggtggatatgatcgaccaatccggtgtcgatgaagtcaaagtccgtacgccgattacttgtaaaacccgtcacggcctgtgtgcacactgttacggtcgtgacttggcacgcggcaaactggttaacgccggtgaggcagtcggtgtgattgctgcacaatccattggcgaaccgggtacccagttgaccatgcgtacgttccacatcggtggtgcggcatcccgtgcggcagcagccagccaagtggaagccaaatccaacggtacggcacgattcagcagccagatgcgctacgttgccaacaacaaaggcgagttggttgtcatcggccgttcttgtgaagtcgtgattcacgacgatatcggccgtgaacgcgaacgccacaaagtaccttacggtgccatcctgctggtacaagacggtatggccattaaagccggtcaaaccttggcaacctgggatccgcatacccgtccgatgattaccgaacacgcaggtatggtgaaattcgaaaacgtggaagagggcgttaccgttgccaaacaaaccgatgatgtaaccggtttgtccactttggtggtgattgacggtaaacgtcgttcctctagtgcttccaaactgctgcgtccgactgtgaaactcttggacgaaaacggcgtggaaatctgtattcccggtacttctactccggtatccatggcattccccgttggtgcggtgattaccgtacgcgaaggtcaggaaatcggtaaaggcgacgtattggcgcgtattccgcaagcctcttccaaaacccgcgacattaccggcggcctgccgcgcgttgccgaattgtttgaagcacgcgtgccgaaagatgccggtatgttggcggaaattaccggtaccgtttccttcggcaaagagaccaaaggcaagcaacgtctgattgttactgacgtggacggtgtagcatacgagaccttgatttccaaagagaaacaaattctggtacacgacggtcaagtggtaaaccgcggtgaaaccatcgtggacggcgcggtcgatccgcacgatattctgcgtttgcaaggtatcgaagcactggcacgctacattgtccaagaggtgcaagaggtttaccgtctgcaaggtgtgaagatttctgataaacacatcgaagtcatcatccgtcaaatgttgcgccgtgtgaacattgcggatgccggcgaaaccgggttcattaccggagagcaggtcgaacgcggcgatgtgatggcggccaatgaaaaagctttggaagaaggcaaagaaccggcgcgttacgaaaacgtattgctgggtattaccaaagcttccctgtccaccgacagcttcatttctgccgcatcgttccaagaaacgacccgcgttctgaccgaagccgcgattatgggcaaacaagacgagttgcgtggtttgaaagaaaacgtcatcgtcggtcgcttgattcctgccggtaccggtttgacttaccaccgcagccgtcatcaacaatggcaagaggtggaacaggagactgccgaaacccaagtaacggatgaataatctttggtgcatccattcaataaaaaaccgcaagccttgagcttgcggtttttctttgtccgattaaggcaaaaacaagcgttttcgtcattttgaggcgtgtggattattccttaggtattttcgggccggagaccaacgaggtggcgggtgtcgtcggtacgtccggagaccaaaataactttgccagggatgttggtttcggcggtcaaaaaaagtagcgtcttaatgttttccatttaaacaaatgtcgtctgaaacttcagacggcatttcctttaagaaataaatatgaaacccagaaatctcttttttgcaggctgcctgctgacttcggcgacgtttgccgaggatatcggcgtacctgtcgaactgattaacgtcggtaatcggattgcgatgccgtctgaaggggaaagcctcgccctcctgccgtttgccgaggatgtaccgccggttcgcgatgcaatgccgtctgaagttcctaaaagcgcggcaggcggcgatgttcggggtgaccggatgagaatgccgattaacatcggatgagcgcggctttatggcataaaaaactgtcgtggaaaggatttacaccccaaataaatttccgttacaacaagatcaacagcaatatgcccgccttttattcgcgcagcggcaaggaacggtttgtcagtatagaaaaaacgtattgacagtattttcttcagtcgtccgactgattgtgagggatgtcggtaaatatttatcggcaaacaagaaaatcatctttcttcttgtcgttatgcttgactgtctgcttgcaataaaaatataattccactcttgccgacatggtgtcggcaagtatttaactcaacaggacgagaaaatatgccaactatcaaccaattagtacgcaaaggccgtcaaaagcccgtgtacgtaaacaaagtgcccgcactggaagcttgcccgcaaaaacgtggcgtgtgcacccgtgtatacacaactacccctaaaaaacctaactctgcattgcgtaaagtatgtaaagtccgcctgaccaacggttttgaagtcatttcatacatcggcggcgaaggtcacaacctgcaagagcacagtgtcgtattgattcgcggcggtcgtgtaaaagacttgccaggtgtgcgttaccacactgtacgcggttctttggatactgcaggtgttaaagaccgtaaacaagcccgttccaaatacggtgctaagcgtcctaaataattactgggacttaaataggcacgtcggccgcctaagctgaacaacggccgagtaagtgaatactcaattgggtattcatgggaatagacccgactgaatagattaaaggaaattaaaatgccaagacgtagagaagtccccaagcgcgacgtactgccagatcctaaattcggcagcgtcgagttgaccaaattcatgaacgtattgatgattgacggtaaaaaatccgttgccgagcgtatcgtttacggtgcgttggaacagattgagaaaaaaaccggcaaagtagcaatcgaagtatttaacgaagccattgcaaacgccaaacctatcgtggaagtgaaaagccgccgtgtaggtggtgcaaactaccaagttcctgttgaagttcgtccttcacgccgtttggctttggcaatgcgctgggttcgcgatgcggcccgcaaacgtggtgagaaatccatggacctgcgtttggcaggcgaattgattgatgcgtccgaaggccgtggcggtgcgttgaaaaaacgtgaagaagtacaccgtatggctgaagccaacaaagcattctctcacttccgtttctaattttgaaaggctaataaaatggctcgtaagaccccgatcagcctgtaccgtaacatcggtatttccgcccatattgacgcgggtaaaaccacgacgacagaacgtattttgttctataccggtttgacccacaagctgggcgaagtgcatgacggtgcggctactaccgactacatggaacaagagcaagagcgcggtattaccattacctccgctgccgttacttcctactggtccggtatggcgaaacaattccccgagcaccgcttcaacatcatcgacaccccgggacacgttgactttaccgtagaggtagagcgttctatgcgtgtattggacggcgcggtaatggtttactgcgcggtgggcggtgttcaaccccaatctgaaaccgtatggcggcaagccaacaaataccaagtgccgcgcttggcgtttgtcaataaaatggaccgtcagggtgccaacttcttccgtgttgtcgagcaaatgaaaacccgtttgcgcgcaaaccctgtacctatcgtcattccggttggtgcggaagacaacttcagcggtgtggttgatttgttgaaaatgaaatccatcatttggaatgaagtcgataaaggtacaacctttacctatggcgatattcctgccgaattggtcgaaactgccgaagaatggcgtcaaaatatgattgaagccgcagccgaagccagcgaagaactgatggacaaatacttaggcggcgacgagctgaccgaagaagaaatcgtaggcgcgttgcgtcaacgtactttggcaggcgaaattcagcctatgctgtgtggttctgcatttaaaaacaaaggtgttcaacgtatgttggacgcagttgtagaattgctgccagctcctaccgatattcctccggttcaaggtgtcaacccgaataccgaggaagccgacagccgtcaagccagcgatgaagagaaattctctgcattggcgttcaaaatgttgaacgacaaatacgtcggtcagctgacctttatccgcgtttactcaggcgtagtaaaatccggcgataccgtattgaactccgtaaaaggcactcgcgaacgtatcggtcgtttggtacaaatgactgccgcagaccgtactgaaatcgaagaagtacgcgccggcgacatcgcagccgctattggtctgaaagacgttactaccggtgaaaccttgtgtgcggaaagcgcgccgattatcttggaacgtatggaattccccgagccggtaatccatattgccgttgagccgaaaaccaaagccgaccaagagaaaatgggtatcgccctgaaccgcttggctaaagaagacccttctttccgtgtccgtacagacgaagaatccggtcaaaccattatttccggtatgggtgagctgcacttggaaattattgttgaccgtatgaaacgcgaattcggtgtggaagcaaatatcggtgcgcctcaagtggcttaccgtgaaactatccgcaaagccgttaaagccgaatacaaacatgcaaaacaatccggtggtaaaggtcaatacggtcacgttgtgattgaaatggaacctatggaaccgggtggtgaaggttacgagtttatcgatgaaattaaaggtggtgtgattcctcgcgaatttattccgtctgtcgataaaggtatccgcgatacgttgcctaacggtatcgttgccggctatcctgtagttgacgtacgtatccgtctggtattcggttcttaccatgatgtcgactcttcccaattggcatttgaattggctgcttctcaagcgtttaaagaaggtatgcgtcaagcatctcctgccctgcttgagccaatcatggcagttgaagtggaaaccccggaagaatacatgggcgacgtaatgggcgacttgaaccgccgtcgcggtgttgtattgggtatggatgatgacggtatcggcggtaaaaaagtccgtgccgaagtacctttggcagaaatgttcggttactcgaccgacctgcgttctgcaacccaaggccgcgctacttactctatggagttcaagaaatattctgaagctcctgcccacatagctgctgctgtaactgaagcccgtaaaggctaatcagaaaaggccgtctgaaactgaaaataaattttcagacggccattgttctttaatcgatctttatatgtaaaggaattagctcatggctaaggaaaaatttgaacgtagcaaaccgcacgtaaacgttggcaccatcggtcacgttgaccatggtaaaaccactctgactgctgctttgactactattttgtctaaaaaattcggtggcgctgcaaaagcttatgaccaaatcgacaacgctcctgaagaaaaagctcgtggtattaccattaatacctcacacgtagaatacgaaactgaaacccgtcactacgcacacgtagactgcccggggcacgccgactacgttaaaaacatgattaccggcgccgcacaaatggacggtgcaatcctggtatgttccgcagccgacggccctatgccgcaaacccgcgaacacatcctgctggcccgccaagtaggcgtaccttacatcatcgtgttcatgaacaaatgcgacatggtcgacgatgccgagctgttggaactggttgaaatggaaatccgcgacctgctgtccagctacgacttccccggcgatgactgcccgattgtacaaggttccgcactgaaagccttggaaggcgatgccgcttacgaagaaaaaatcttcgaactggctgccgcattggacagctacatcccgactcccgagcgagccgtggacaaaccgttcctgctgcctatcgaagacgtgttctccatttccggccgcggtacagtagtaaccggccgtgtagagcgcggtatcatccacgttggtgacgagattgaaatcgtcggtctgaaagaaacccaaaaaaccacttgtaccggtgttgaaatgttccgcaaactgctggacgaaggtcaggcgggcgacaacgtaggcgtattgctgcgcggtaccaaacgtgaagacgtggaacgcggtcaggtattggctaaaccgggtactatcactcctcacaccaaattcaaagcagaagtatacgtactgagcaaagaagagggtggtcgtcacactccgttcttcgccaactaccgtccgcaattctacttccgtaccaccgacgtaaccggcgcggttactttggaagaaggtgtggaaatggtaatgccgggtgaaaacgtaaccatcaccgtagaactgattgcgcctatcgctatggaagaaggcctgcgctttgcgattcgcgaaggcggccgtaccgtgggtgccggcgtggtttcttctgttatcgcttaattgaaggatattgataaatggcaaaccaaaaaatccgtatccgcctgaaagcttatgattacgccctgattgaccgttctgcacaagaaatcgttgaaactgcaaaacgtaccggtgcagttgtaaaaggcccgattcctttgccgaccaaaatcgagcgtttcaacattttgcgttctccgcacgtgaacaaaacttcccgtgagcaattggaaatccgcacccacttgcgcctgatggacatcgtggattggaccgataaaactaccgatgcgctgatgaagctggatttgccggccggtgttgatgtagaaatcaaagtccaataattcggactataaaaaatccccaagcaatcaatgcttggggattttttatgttatgccgagacctttgcaaaattccccaaaatcccctaaattcccaccaagacatttaggagcaccttcttccagcaaaccgcccaagccatgattgccaaacacatcgaccggttcccactattgaagttggaccgggtaattgattggcagccgatcgaacagtacctgaatcgtcaaagaacccgttaccttagagaccaccgcggccgtcccgcctatcccctgttgtccatgttcaaagccgtcctgctcggacaatggcacagcctctccgatcccgaactcgagcacagcctcatcacccgcatcgatttcaacctgttttgccgctttgacgaactgagcatccccgattacagtcatcaaccatattccggtttgtcggagaaagatgcatacgctgtgatgaccggataccgacccgttaaaagagtccgaccctatgccgtctgaaaattcaaaacgcttcagacggcatattgaagatatttctgatatttctgttgatatttctttgacttgtcagatataatgccgagcttggtacatttgtgccaagtttaactttgtctgaaagacaggccaatcgtagcctgtccctttactttaaaaggaaaataatcatgactttaggtctggttggacgcaaagttggtatgacccgcgtgttcgacgaacagggtgtttctgttccggtaaccgttttggatatgtctgccaaccgcgttacacaagtaaaatccaaagatactgacggctatactgccgttcaagttacctttggtcagaaaaaagccaatcgtgtcaacaaagccgaagccgggcactttgcaaaagcaggtgttgaagccggtcgcggtttgattgagtttgctttgactgaagaaaaactggctgaattgaaagctggtgacgaaatcaccgtttctatgtttgaagtcggtcaactggtcgatgtaaccggtacctctaaaggtaaaggtttctccggcacgattaaacgtcataacttcggtgcccaacttattccgcttgcagcttgccgctgaagcgtaccaatacagactcgggcatatcgagcggcattacgcccgttgcggcggcaaatgcaacgggta

SEQ ID NO: 37843 - DNA, 5880 bp, Neisseria meningitidis
  misc_feature (6)..(6): N is any nucleotide
ttttcntagcaggcatcaaactgcccggcagcatcgtcggcatgggcgtgctgtttgcgcttttgcaggcgggttgggtcaaaacgtcttggctgcaacagcttaccgacgcgctgatgtcgaacctgacgctgttcctcgtgccgccctgcgtggcggtcatcagctatttggatttgattgccgacgattggttttcgatactggtttccgcctccgccagcactttgtgcgtactgctggttacgggcaaagtccaccggtggatacggggtattatccgatgaacgaaatcctcaggcagcccagcgttctgcttttcctcacgcttgccgtgtacgcgcttgcgattatcgtgcgcacgcgcacgggcaatatcttctgcaaccccgtactcgtcagcactatcgtgctgattgcctacctgaaaatcctcggtatcgattatgcggtgtaccacaacgccgcgcaattcattgatttttggctgaaacccgccgtcgtcgtgcttgccgtgccgctctaccaaaaccgccgtaaaatcttcaaccagtggctgcccgtcatcgtttcacagcttgcgggcagcgttacgggcattgttacagggatgtattttgccaaatggctgggcgcggaacgcgaagtcgtcctctcgctcgcgtccaaatctgttaccaaccccatcgctattgaaatcacccgctccatcggcggcattcccgccattaccgccgccaccgtcatcattgccggtctggtcggacagattgccggttacaaaatgctgaagaacacggtcgtcatgccctcgtccgtgggtatgtcgctcggcacggcttcgcacgcgatggggattgccgcctcgctcgaacgcagccgccgtatggcggcatacgcggggctggggctgacgttcaacggcgtactgaccgcgctgattgcgccgctgctcatccccgttttgggattttgaacccgtttcagacggcatttcagcccatgctgtctgaacgccgacacactcgcaaggagaaccgttatggctgtcaacctgaccgaaaaaaccgccgaacaactgcccgacatcgacggcattgccctctacaccgcccaagcaggcgtgaagaagcccgggcataccgacctgacactgattgccgtagccgccggcagcaccgtcggtgcagtcttcacgaccaaccgtttctgtgccgcgcccgtccacatcgccaaatcgcaccttttcgacgaagacggcgtgcgcgccctcgtcatcaacacgggcaacgccaacgcgggtacgggcgcacagggcagaatcgatgctttggcagtgtgtgccgccgccgcccggcaaatcggctgcaaaccgaaccaggtgctgcccttctccaccggcgtgattctcgaaccgctgcccgcagacaaaatcatcgccgccctgcccaaaatgcagcctgccttctggaacgaagcggcacgcgccatcatgaccaccgacaccgtgcccaaagccgcctcgcgcgaaggcaaggtcggcgacaaacacaccgtccgcgccacgggcatcgccaaaggctcgggcatgattcatcccaatatggcgaccatgctcggtttcatcgccaccgatgccaaagtttcccaacccgtcctccaactgatgacgcaggaaatcgccgacgaaaccttcaacaccatcaccgttgacggcgacaccagcaccaacgacagcttcgtcatcatcgccaccggcaaaaacagccaaagcgaaatcgacaacatcgccgacccgcgttacgcccaactcaaagaattgttgtgcagcctcgcgctcgaactcgcccaagccatcgtccgcgacggcgaaggtgcgaccaagttcatcaccgtccgcgtcgaaaacgccaaaacccgcgacgaagcccgccaagccgcctacgccgtggcacgttcgccgctggtcaaaaccgcctttttcgcctccgaccccaacctcggcaggctgctcgccgccatcggttatgccggcgttgccgacctcgataccgacctcgtggaaatgtatctcgacgatattttggttgccgaacacggcggacgcgccgcaagctacaccgaagcacaagggcaggcggtgatgtcgaaggccgaaatcaccgtccgcatcaagctgcatcgcggacaagccgccgccaccgtctatacctgcgacctgtcgcacggatacgtttccatcaacgccgattaccgttcctgacccgacacggcttcagacggcatacataaaatgccgtctgaaccgccggacaacataccatgacctccacattcccccgccgcctcgcccgcaaaatccgccaaacccgccgcctgtcgcgcaaaagcatcgcctttctgttccttttggcaggttcggcactcgtcgccctgaccgcgctgttttttgcccatcttgccgattttgcgctggaactgaacgccaaactggttcaacaatacccgtggttcgcgtgggtcgcgcttcctttgggtttaccgcttattgcgtggctcacacgcaaattcgcccccttcaccgccggcagcggcatcccgcaggtcatcgcctcactgtcgctgccctacggcgcacagaaaacgcggctgatccgcctcgggcagacgctgctgaagattccgctaacctttttgggtatgctgttcggcgcgtccatcggacgcgaaggtccgtccgtgcaggtcggcgcggcagtgatgggcgcgtggggcgcgtggtgcaagaaacacggcttggcattcaaagggatgcaggaaaacgatttgatggcggcgggcgcggcgggcggtttggcagccgcgttcaacgcgccgctggcgggcgtgattttcgccattgaggaactcgggcgcggcatcatgttgcgctgggagaggcaaattcttttgggcgtgctcgcctccggtttcatacaggtcgccattcagggcaacaacccgtatttttccggcttcaacggcggcgtattggaacatatctttctgtgggtcgcactgtccggcctggtttgcggcgcggcgggcgggctgttcggacgtttgctctatcgcggtgcggcggcgtttgcaccgcgcaagatacgcggcttcatccgcaaccgtccgctgctgctggcggcactgatggggctgctgctcgccctgctcggcacgttctaccaaggcaaaacctacggcaccggctaccacgaagccgcccaagccctgcacggcatctacgaagcccccttcggactcgccgccgccaaatggctcgccaccgtattcagctattgggcaggcgttccgggcggcattttcactccctcgctgaccataggcgcggttttgggcgagcatatcgccgccatcgccgacatatcgcagggtgcaaacatcatcgtcctcatctgcatggcggcatttctggcgggcgcgacacaatccccgattacttccgccgtcgtcgtcatggaaatgacgggcggacaaagcctgctgttttggatgctaattgcctgcattttcgcctcgcaggtttcgcgccagttttcgccgcgtccgttctaccacgcatcgggaatgcgcttccgccagcgcgtgcttcaagaaaccgccgcccaaaccggcaatgcgcccgcaagaccgcaaacagcaaacagcaaaacgggaatgccgtctgaaaattaaaacgcccccgatcaaacgccggcagccgccttgatttgaataccgttccgccgccgcttgaaatttcagcaacaatgccgtctgaacgacagaatgcggttttcagacggcatttccccatcccgatattgcctaaacaaaaccgaagcgtttgctataattctattttttaccgcatacgcaccaatcatgtttcccgatttctcccaaaccctctccaaagaccgccacttcctgcgttccgccttcaaaaatcccaacaaatacggcggtttgtccaaaatcgaagaaaaataccgaaaatcgcacgaaatctttttgaagcgtttggcagccttgccaaaacccgaattcgacaacaccctgcccgttcacgagaagctcgaagaaatcaaaaaagccattgccaagaatcaggtaacgattatttgcggcgaaaccggttcgggcaaaaccacgcagttgcccaagatttgcttggaactcgggcgtggggcggcaggattgatcgggcatacccagccgcgccgtttggccgcgcgctccgtagcagagcggattgccgaagagctgaaatccgaaatcggcagcgcggtcggctataaagtacgcttcaccgaccacacctcgcgcgatgcctgcgtcaagctgatgaccgacggcatcctgctggcggaaacgcagaccgaccgttatctcgccgcctacgacacgattatcatcgacgaagcgcacgagcgcagcctgaacatcgacttccttttgggctatttgaaacaactcctgccgcgccgccccgatttgaaagtcatcatcacctcggcaacgatagacgcagaacgcttctcccgacacttcaacggcgcgcccgttttagaagtgagcggacggacgtatcccgtcgaaatcctctaccgaccgctgaccggcaaagacgaagacgacgcagaagtggagttgaccgacgcgattgtcgatgcggcggacgaattagcgcgacacggcgaaggcgatattttggtattcctgccgggcgagcgcgaaatccgcgaaactgccgaagccctgcgcaaatccacgctgcgccgcaacgacgaaatcctgcccctgttcgcacgcctgtcgcacgccgagcagcacaaaatcttccacccctcaggcgcgaaacgccgcatcgtattggcaaccaacgtcgccgaaacctcgcttaccgtgccgggcatcaaatacgtcatcgacaccggcctcgcgcgtgttaaacgctattccgcacgggcgaaagtggagcagcttcatatcgaaaaaatctcccaagccgccgcccgccaacgatccggccgctgcggacgcgtctccgcaggcgtgtgtatccgactgttttcagaagaagattttaacagccgccccgaatttaccgaccccgaaatcgtccgcagcaacctcgccgccgtcatcctgcgcatggcagcattgaaactcggcgatgtggcggcattcccgtttttagaaatgcccgattcacggtatatcaatgacggttttcaggtgttgttggagttgggggcggtggaggccgtctgaaaacaggcagacataaaagaaaatccgcgtagagtgatgtaaacttacccttgctttaataagtagaaaatggtgggtttacgtccccccctgcggctactaaaaaaatataagagtaaacaacctttttgaaagaaaaatgtatggacgaaattcaaatacccaaaaaagtggaattacaaaccaaactagaaaatgaaaagattgttttatcgaaaggttctaccacgattattgttggtgctaatggcacagggaaaacaagattagctgtttatattgaagaacaattaaaggaaaaagcacacagaatttcggctcatagagcattaaaattaaaccctaatgtcaataaaataccagaaaagagtgccaaaacatatctatcttatggtcagaactgggatggaatcgatgtatcaaatagaaaaaattatagatgggataataactcatatactcatttactcaacgattttgattggttattacaatatttattcgctcaacaaaataatattgcggtagcaaataatcaaaagctcaaccgtaatgaaaaagtaaccg

SEQ ID NO: 37844 - DNA, 24158 bp, Neisseria meningitidis
gcccctggcttcttaaaggttgtccgcccaaatgctcaatgacaaggacttgccgttaaagcggtaagaaaacgtgtactcattcataggagaaaccttatgtattttgaaatctataaagacgcaaaaggcgaataccgttggcgtttgaaagcagccaaccatgaaatcatcgctcagggcgaaggctacaccagcaagcaaaactgtcagcacgcagtcgatttgctgaaaagcactaccgccgctacccctgtaaaagaggtataaaatccgctttcaccctcagcccgcgccctacgcgggcttttttgtcagtttccgactttgcgggagtgattgcccgcccagtcgcgccaagcctgattttgattttccaactccgccacatagccaccaaactcagcggcgtgttccaacagcgtggccgtcttgccgtctttcggcggattcgggcgtaccggcgcgaccatcaatgcagcaggcggggtcggcatgactgccttttcgacaaccttaatttccgtagccgagggcgcggttgtagagctgcaggccgtgagagccaaagccgtcaatgcaaccgccgcttgcatttttacggtcttgagtaaggacattttcgatttcctttttattttccgttttcagacggctgacttccgcctgttttttcgccaaagccatgccgacagcgtgcgccttgacttcatattttttagcttccgcgcgtgccagttccagttcgcgcgcatagttttgagccgacaacagcagggcttgcgccttgtcgcgctccatcttgtcgatgaccgcctgctgcttcgcaaatgccgacttgtagccttgatggtgcgacacagccaagcccgtgccgacaagcgcgataatggcaatcggttgccagttattcgccagcagtttcacgagattcattctcgacctcctgacgcttcacgctgacaaatgaacgcgccaccgcatagccgccgacaatgcccaaatacaccgcccaaatttccgccgacggatcgggcaacatcacaaacttaaacgtcccagccgcgcaggcaacgtttgcccacagtttcgagtgcgacacattgcctgtcgccgggtttttaaaaatatccaaaatacgcattgctattccacacttttggtttgcaggtgccgtttcagcatttcccgataattggccagttcgccctccgcaaattcaaacgcagccaagtccgcctgttcgcttgcctcacggcttttggccgaccacagcccaatcatcttttcgtaaaacgcaacctgtcccatgattaacgacgattcttgcgtttgcgcgccgcacgtttagcagccgccacgcctgatttacccaagcgcaggctcggatgttgtttcaaagagcctacccgaacagggcttggcgtgattttgatttcaggtaacggtggtacgccaaaatcgtttttcaactttgcacaatgggcaacacataaagcaatcaaagactttttcataccttcgccgctcccaattccatcgcaatcgcgtccgcaatcgcgcggcagatgccccatttggtcgtcttaaacaaggccaaatcagtgtcgttgctgatgaaaaaaggctcaaacacaatgccgcctgcctgcgcataagccaggcgcgaatgttgccctgcgttatccggcttaaagccgtcttcgccgcgcagtttccagccggttttcttggcaacggctttgcccagcacctgacaccagcgtttatttttcggcgtggacaaggcttcgatgcctgtcgccgttttgttcgccgccgcattggtgtggaactcaatcgccacatccgagccgcgaatcagcttgaccgcatcgcgcagcggcatattgcctttgcccgtgccgtcggttttaacggtcaggccgtaatcgttacgcaggattgaagccacaatgttgcgcatatcctgcgccaagtccgcctcacggtcgcttccgttgaccgcacccgggtcggtgttgctgtgtccagcggttaaggttacggttttgcccattcatcatctccaaaaaatattgattgcatatagtggattaacaaaaatcaggacaaggcgacgaagccgcagacagtacagatagtacggaaccgattcacttggtgcttcagcaccttagagaatcgttctctttgagctaaggcgaggcaacgccgtactggtttttgttaatccactataacatttgaaaaccccattaaaccgtctttaacccatcgtcccgaacggtagatgtttcacccctgcaaaccaaaaaaaagaccgtctgaatacagacggccaaagcctggtcacacatcactgcctaaaataaagctgcctgctgtgccgcaggtcggctcatttcattgataatcgtatatcccgttcgtgaagagatgccgtatttagggcatagcttcgtcatcgccataagcccgctcttcttatcaatatcgcgcaatttgacaaactcctgataaaacctatggtttctcaactgtattaacgccttgccgcaccgtgggacatacaattcctcgccaccatatacctgcaacagctcatgtgttttcacttcgccgatggcttcgaccaaaattgccaaacgctcggtgtccaccttgcccttaccaaatttaaaccgcgccccgccaatcgccttgaccagctgttccgtcgctgccagtccgatgacatccacaatgtccaacacggtatccggcaataaatgttcaactttttcgaaccccatcatccccacccgctttttccgttttcctgttttccgcaatctgcaacgcagcaaccagtttatgtagctgcgtatcgtctaaatattcgaccttatccttaccaaacatccgccgcgccattgcgtgtgcatagttccaatgtttgccgccgacggtcagcagggcttcgactttgtccaacattgccgctgatgatgtccgacgcagatgcggtttgccgtgtgggttaccttttgctttaggcttaaatccgtgcgaccgcatatcagcgacaacagactcaagttcggaaacatccatatccgcacacgaccgcttgcccgtcacacgctccaacaccgcgcgataggtaccgtcatccaagcccagctccttttgagcaatcttaattttcgcaatcaacgcccggcgcatctcaaacccataaaacacaatatatagtattaagccgatgttttttgcgaaacggacagacataaaaaagcaactgtatttttcaccccgtcgggcaaaaataccaaaactcaaatcaagccgtttagataccgttttcggcggtatcgttttcggcaaaataatcacgcatccgggcattcgatatcgtcagcagtttgcgcatacatgccgtaacggcaaccttatacggcttaccctcggacggcaggcgttggtagaaatcccgaataagcggttcaaaacgtgtcgctgccacggtagccatatacagtgccttacgcaccgcagaccttccgccaaagcagcggcttttgaatttggtttccccgctctccctcgggtgtggggcaatgccgactagactcgctatccgtttgtgcgacagccgccccaattcgggcaacatcgccatcagcgtagccgtcgttatcgaaccgatgcctttgatttgctctgccacttgggctttgccgtcaaaatgcgtgtgggtgtggttgtcgatttgtttgtccaattcgtcaatcagccggtcaaaatgggcaatcagttgtttgacgctttcgacttgcgtttcatgaacctaatgcagacggtttttctcggcagtccgcatatccaccagttggttgcggcggttaaccaaggcttccaacacttcttccacttcggtgggcgggtggtagggcatggtttgcgaatcttctttctgtgccgtcatctgtgcgaagaaggcgggcattttggcatctttggcgtcggttttggtcagcggctgcgattgggcaaactgatgcgtctgacgcgggttggcgataatcacggccctgctcggcggatggctttggcggcggggatttcgagaccgccggtactttccgtcacgacgagggcgaccttgtgttttttaaggtattcgatagtatgggcgatacctttggggttgttggtttcggttttggttttagacaaagacgaaacggcgatgacgaagtttcgtttggcgatgtcgatatagtgaattaacaaaaatcaggacaaggcggcgagccgcagacagtacaaatagtacgaaaccgattcacttggtgcttcagcaccttagagaatcgttctctttgagctaaggcgaaccaacgctgtactggtttagatttaattcactatacctgcgtaatggtattgggtactcatcataaacctgccttgcattcggttgtgttgtccggcaactgtccggttgtgtcgatgggttgccctgccgctccctgagctacgcaacggttgtgtgccttgggtgggcgcgggtggcggctgggcggtttgttgctatgatacggtgattccaatatacaagggtgggcttcagtccaccgcttccgtcgattccgtcaatgttacccatttccaccgtccccgccgaaaccaaaaccgccgactcccgccggttctccaaaaatttttgatgcagcgggctgaagcacaccctgcatcccaccttttacgaatcctcctacaccctatacaacaccttgaaaatccaccctgtcaggaatacccgaaccgtcatccctaccttcgcaaaatagcgcaaaataccgtctgaaagcccttcagacggcattaccttgtttatctgcatcaatggcggaaatggcggatgccggttacgaccatggcgatgccgtgttcgtcggctgcgtcgaaaacttcctgatcgcgcatcgagcctgccggatggatgatggctttgatgccctgttcggcaatcacgtccacgccgtcgcggaaggggaagaaggcatcggatgcggcacacgcgccgttgaggtcgagaccggcatcttgcgctttgcgggcggcgatgcgggtgctgtccacgcggctcatttggcctgcgccgatgccgtaggtttgaccgcctttgccgaatacgatggcgttggatttgacgtatttggcgacgttccagacgaacagcaaatcgttccattcctgctcggtcggttggcgtttggagacgactttcaaatcggcgcggctgatgcggtggatgtcgggcgtttgcaccaacagtccgccgccgacgcgtttgagttcgaagcggtttgcgcctgcctcaagcggcacttccaatacgcgcacgtttttcttggcggcggcgatttcgagggcttcggcggtgaacttaggcgccatgaggacttccataaactggttgtcggtaatttgtttgacggttgcgccgtcaacttcgcggttgaaagcgatgatgccgccgaacgcgctggtggtgtcggtggcgtaggcgagtttgtaggcatccaaggtattggaggcgatggctacgccgcacggattggcgtgtttcacaatcacgcaggcgggcacgtcgaaggatttgacggcttcccatgcggcatcggcatcggcgatgttgttgtaagacaattctttgccttgcagttgtttgtatgcagcgaggctgcctgcggcggggtcaatatcgcggtagaacgcggcgcgctgatgcgggttttcgccgtagcgcatgtcttgcactttaatccagctttgattgaaccggccggggaatccggcgatttcgggcgtgccgctcaagacgtcgtctgaaagcgaggtcaggtaattggaaatcataccgtcgtattgggcggtatggctgaatgctttgcgcgagaggttgaaacgggttttgtcgctcaatgcgccgttgttggcttcgagttcggcagctatggccgggaaatcggcggtgtcggtaacgatggcgacgtgtttccagtttttcgcggcagagcgcaccatggtcgggccgccgatgtcgatgttttcaatcgcgtcttccagcgtgcagtttggtttggcgatggtggcagcgaagaggtagaggttgacgcacacgaggtcgatattgccgatgccgtgttcttccatcttggcgacgtgttcgtccaaatcgcgacgaccgagaataccgccgtggattttcggatgcagggttttcacgcggccgtcgagcatttcgggaaaaccggtatagtcggcaacttcgataacgggaacgcctgcatcagccaagagttttgctgtaccgccggtagaaagaatttcgacaccgagtttgtgcagggtttgggcaaattcgactgcgcctgtcttgtcggataggctgatcagggcgcgtttgatggaagacatttggatttcctttgttgaaggtttaatcagtatgggatgaattttcagggcggtattatcccccagtttcgcatttttggcagtaggtttttgcaaatattgttaacaattttattgtaaaaggccgtctgaaacttggtttcagacggccttttgcttttgcctatttaaatcccattttctttgccacccatactgcacctgccatgcctgtacataatggcatgagcaaggcaacaggggcgtaggtgagctccaaaataaaggctatggcggtcaggggcattttaagggaaacaccgaggaaaactgcggcgccgacaatggctgcgctttcagaggacatttcaggaaaaacactgttccacgcggtggcagcagcaaaggcgatggtactgccgagcatcatggacggggtaatcagaccgccgtatgcgccgacggcaagcgccattaagacgaccagccatttgacggcggtcagcccaaggctgtgttgccaatcggtcaatccgccaaaggtcagttgattgcctgctttgccattgcccaaaatttcgggaaaccaaacggaaatcacgccgatgagtgcaaacatacagacggccaagggaataattttgatattgtcgcgcttgataaaggggaacttttgggcggtacgctggaaaaagacggcggctacgcccagtatcgggccgatgacggcggaaaaccaaagtaatgaagtattgacggtaaggttggccggatgatattgctgcacgtcgcccaagccgatgcgcgcgacggcggtggcgatgactgaagttaacaatgcagcggcgacggcttgctgcgtccacacgcccagcatggcttcgagaatgaaaagtgtggaggcgagcggcacgttatacacggccgccaaacccgcacccgaagcgcaagcaatcagtagccgcatttcgccttcatccaaacccaagcgtttgccgccggcaaaagcaaacgcggcggtcatttcgcgcggggcgacttcgcgtccgagcggcgaaccgagtccgaccgttatgatttgcagcagaacatggaaaaccgtcgtcagaaacggcagcccctgcaacggctgtttcaaggcggctttgatttcgatttgcggcttgccgaaacgtttcagcaaccaccagccgctgcctgcgaccgcgccgcacagcgtcagcacggcaacgcgccgcataccggaagcctgtgccacgccttcgcggaacgaagtgtacacgccgtccgcgccataaccgtatgccgtatgctgtatgaagtgcatcagttccgtcagcacaatgccgaccaaaccgccgataacgcccgctgctgccagggcaaaccaaagttttctgcgtcccactgtcgttcctgccgttcaaatgccgtctgaaaacctttcggacgacatccgtttcctatccgcctatccgaacaggccgcgtacacgctccaaaccgccgaagttgatacaggcatcggcggcggcccgcgctttcggtttggcacggtaagccacgcctatgcccgcttctttgagcatcggaatatcgttcgcaccgtcgcccaccgccaacacctgatgcggctgcaatccgaggcggctgcggtattcgcgcaacaaatctgcctttgcctgcgcgtcgatgattctgcctttcagacggccggtcagcctgccgttttcaatttccaaaacattggcgtgttggtattcgaagccgaggcgttgttgcagcctttcggtaaaaaacgtgaagccgcccgacaccagcaggaatttcacatcgtgccttttgcattcgtccaacaaaaattccgcaccgggcgagagcttcaaaacgttttcataaacgtccgccaaaacccgttcgtccaatcccgccaacagcgcgacgcggctgcgtaaagactgttcgaaatcgagttcgccgcgcatcgaacgctcggtaatttccgctactttgttttttaaacccacgcctgccgcaatttcatcgacgcattcgatggtaatcagcgtcgaatccatatcgctgacaatcaaaccgagttcgtcgaaatccatatccggcaacacggcgtggtcgatttgacggctgccaagcaacgccgcgtctttttcgcttaaagaaaacccttcttcaacgataaaacgcatacgcttttcatcggcgcaatcaggttcgggcaggcgtaaggggaagtcggaaggcagggctgcggcggagggaaattggaggacgagggcgtgcggcataacggcggctcaaaaaatgcggattatatagtgaaacggcaaagaatgttacggcgggcgggactgcaatcggaaaacgatttcaaacacaaacggcagtatgtgtcggacaacacgggaaaatgccgcaactattgccagcctgatgaaaattcgttataaggggattatctaaaatatattaacatttgaagtgagtcggctttaaaccggtacggcgttgctccgccccgccccgatttaaatttaacccacgatacatataaacaacccgaaaaaggattcagagatgaaaatcggtatcccacgcgagtcattatccggcgaaacccgcgtcgcctgtacgcccgccaccgtcgccctgctgggcaaactgggctttgaaaccgttgtcgaaagcggtgcaggtttggcggcaagtttggacgatgccgcttaccaaacagcaggcgcaaccgttgccgacaaagcggcggtttgggtctgccctttgatttataaggtcaacgcgccgtccgaacaggaactgccgcttttgaacgaaggtcaaaccatcgtcagcttcctgtggccgcgccaaaacgaggctttggtcgaagccttgcgcgccaagaaagtgaacgcgctggcgatggatatggtgccccgcatttcgcgcgcgcaggctttggacgctttgtcttcgatggcaaacatcagcggctaccgcgccgtaattgaagccgccaacgccttcggccgtttcttcaccggtcaaattaccgccgccggcaaagtgccgcccgcgcaggttttggtgattggtgcaggtgtggcaggtttggcggcgatcggtacggcaaactcgctcggcgcagtggtacgcgcgttcgatacccgcttggaagtggcggaacaaatcgaatcgatgggcggcaagttcctgaaactcgacttcccacaagaatcgggcggcagcggagacggctacgccaaagtgatgagcgacgaatttatcgcagccgagatgaagctctttgccgagcaggcgaaagaagtggacatcatcatcaccaccgccgccattccgggcaaacccgcgcccaagctgattaccaaagaaatggtggaaagcatgaaatccggctccgtcatcgtcgatttggcggcggcgacgggcggcaactgcgaactcacccgcccgggcgaattgtccgtaaccggcaacggcgtgaaaatcatcggctacaccgacatggcaaaccgccttgccggacagtcttcccagctttacgccaccaacttggtcaacctgaccaagctgttaagcccgaacaaagacggcgaaatcacgttggacttcgaagacgtgattatccgcaacatgaccgttacccacgacggcgaaatcaccttcccgcctccgccgattcaagtttccgcccagccgcagcaaacgccgtctgaaaaagccgtgcctgccgccaagcccgagccaaaacccgttcccctgtggaaaaaactcgcgcccgccgtcatcgccgccgtcttggtactgtgggtcggcgcggtcgcacccgcagcattcctgaaccactttatcgtgttcgttctcgcctgcgtcatcggctactacgtcgtctggaacgtcagccactcgctgcacacaccgctgatgtcggtaaccaacgccatctccggcatcatcgtcgtcggcgcgctgctgcaaatcggtcagggcaacggcttcgtttcgctgctgtcgtttgttgccatcctgattgccggcatcaacatcttcggcggctttgcggtaacacggcgtatgctgaatatgtttaagaaagggtaagccatgactttcgcctattggtgtattctgattgcctgcctattgccgcttttttgtgcggcgtatgccaaaaaagcgggcggattccggtttaaagacaaccacaatccgcgcggttttctagcgcacacgcaaggcgcagccgcccgtgcccacgccgcacagcaaaacggttttgaagcctttgcaccgtttgccgccgccgttttgacggcacacgcaaccggcaatgcggcgcaatcgaccatcaacacgcttgcctgcctgttcatcctgttccgcctcgcctttatctggtgctatatcgccgacaaagccgctatgcgctcactgatgtgggcaggcggatttgcctgcaccgtcgggctgtttgtcgcggctgcttgaaacagatgccgtctgaaaacacgaacgtcaatttttcagacggcattgaaaacaaatcatcgaaaatcggagaatttctatgtcttcaggactcgtaacagcggcgtatatcgttgccgcaattttattcatcttctcactggcggggctgtccaaacaggaaaccgccaaacagggctgctattccggtatcgccggtatggcggtcgccctttttgtaactgttttttccgacaatacccacggactgggctggatcatcatcgccatgctcatcggcgcggcaatcggcatctacaaagccaaaaaggtggaaatgaccgaaatgcccgaactgattgccctgctgcacagcttcgtcggcctagcggcggttttggtcggcttcaacagctatatcgcgccgggcaacgtttcgcacgatatgcacaccatccatctggtcgaagtgtatttaggcatcttcatcggcgcggtaacctttaccggctcgctggtcgcattcggcaaactcaacggcaaaatcagcagcagcccgctgcaactgcccgccaaacacaagctcaacgcactggcacttgccgtatcgtttgtgttgctgctcgtatttgtcggcattgacggcagcggcttcatcctgctgattatgaccctgattgccctcgcattcggctggcacttggttgcctccatcggcggcgcagatatgcccgtggtcgtgtccatgctcaactcctactccggctgggcggccgcagcggcaggcttcatgctctccaacgacctgctcatcgttaccggcgcgctggtcggctcaagcggcgcgattctgtcctacattatgtgcaaagccatgaaccgctcgtttgtctcggtaattgccggtggtttcggcagcgacagcggcacattatcttccggcagccaagagataggggaataccgagaagtcaaagctgccgatattgccgaaatgctgaaaggcgcaaacaatgtcatcattaccccgggctacggtatggcagtcgcacaagcgcaataccccgttgccgaaatcaccgagcttttacgtaaaaacggcaccgaagtacgcttcggcatccaccccgtcgccggccgcctgcccggtcatatgaacgtactgctcgccgaagccaaagtcccctacgacatcgttttggaaatggacgaaatcaacgacgacttccccgaaaccgatgtggtcttggtcatcggtgcgaacgacaccgtcaaccccgccgcccaaaccgacccgaacagcccgattgcgggtatgcccgtgttggaagtgtggaaggcaaaagaagtcgtcgtcttcaaacgctcgatgaataccggctacgcaggtgtacaaaacccactgttcttcaacgaaaacagcgtgatgtgtttcggagatgcgaagaaaaccgtagatgacattctgtccgaactgaaaaaataatgccgtctgaacaattcggcgcaggttttcaatctgtttgatttgaaaaaatcactgcaaaccccgtttatgaaggtttgcagtgatttttttgcattggggcaaacattttcagacggcccgtccgaataagcacctacatctgaaactgacacaaaatcaacgaaacaaacaaaatccatctccgtgttgaagatggatttttaattagccgaacactttttccaagtgtgcctgataatctgccaagtatttttccacttgcggatttttaaccacatcgttacataagaatgtcggcaggcgggtcatacccaaaaactcgttggctttgtggaagtgcatatacaaaacatcaacgcctttgccttcaaagaaatcgccttcgcgggtaaacgcctcaatcggcgcattccaagtcagtgaaagcatatgttttttgccttgcaacaagccgcctgtgccgtagccctcagtcggattgacgctgtgtctgccgtcgctttggtagagtttgccgtgtccagcggttaatactccgtctatgtattttttcactgtccaaggctcgtgcatccaccagcccggcatctgccaaatcacagcatccatccaaacgaatttttcgatttctgcctcaacatcatagccgggaatcgtcagaaatacctgcatcgtcattcccgcgcaggcgggaatctagaccttagaacaacagcaatattcaaagattatctgaaagtccgagattctagattcccgctttcgcgggaatgacgaaaagtggcgggaatgacgaaaagagacctttgcaaaattcctttccctcccgacagccgaaaccccaacacaggttttcggctgttttcaccccaaatacctcctaattttacccaaatacccccttaatcctccccggatacccgataatcaggcatccggggtaccttttaggcggcaacaggcgcacttagcctgagacctttgcaaatttgtcggtttcggggtcgtattggtagcctcgtgcctgtatgtcttctttgaaagtttcgtatacgtcgtgggctaaaagggctgttccgacatagggaaccgcccttgtgctgaatttcgcgcctaagcgggcaagtttgccgacccccgccaatacgccggcgcgggatacgctggcggttattttggcgttgattcgggcttttgcgcccgtagggatgtgtgttaaatctaccgtttttattaaatcagatgaataagttttactatttttaggtacaaacttatgaattttcgcaccttgtccggtatcaactgaaacagtttcagatatttttactgcatttgcattcgcttcaaacgaatacatcatcaaaattgcaattatcgacaatttcgcaaaattcaaatttgtatattttatgaccatctttcagggattctttaattaccatttctgaattatcagaaaatgagattagccaaatatcatgtttaattcttctattccagaaaaaagagaaacaatcaataacattttcagacttattaatcttcgcaaattcaacaaattcagattgcgctataaccgccatcgattgcccaaaatacttgctggacggctgatatttataaagtgccaactgcgcctgagtgataaacggcttgttcatggttctgcctttcaatgattgttttgaaagcctgattttgacaccataacttcatgcgctcaattcttaaacagaaccgccccgattaatacgggtacggaaacgccgagataaaaataaaaatccatcatttcaaaacctttttcagcagggaaacaaagtaaacggacgcgaggatgccgaatactatccagcctgtttcaagaccgctttgcaggttgtctttcggactgcattccgccaataaaagccttagcggctgaccgtccgacatcttccacaggctgccgttatattccggcctgacaatctgtccgttttctttgattcttggtactaccaagctgaaataaaggttttcagcctggtgcttctcaagacatttatttccgacttggtagtacatgccgtcttacttcatcactctcttaacgatggaaaatacaaaaagcgcggcgaaaatgcccactacaatccaaccggcttccataccgtccgcttttgcggcttccaaagcgttttttgccgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaatttggtatgtccgatgtcgcccgtttcaggagagagatacagaaagtcccctgttgatacggactggacaacatagactttctgcattcaatcagcctttcttcacgagttgaaaaccgatgactttcagtttttgggttttgcccgtagtgacgatttctacgttcaggtttgcttcgatcggaaattgggcgtttcggaactgctcgaaattggcagagccgccgaaatcgtattcagtagtagagctgcccaatgcgttgccttgggagctgtctaagggtgtggcgacaatcaggcagcaatagtcgaagctcttgccttcgatttgtccgttgatttttttaacgccgacgatgtggccttgaagttggatgttcattttttggtttccttgtgtgattaaacgtctttcgggcagacactttaagcccatgaaatcggtagtcttgcgaatttgtcgtaaatgaagttgttatagctttcttcattgttgacgtgtttttgctgttcaagctgtttttcaagattctcgtaatattcgtacatatagtaagggtctttgtacggtttgaatgcgggctgttcatgaatggcttgagctttcaaaaaggcgcagtcgtaggcttcgggagccaaagacttgggcagcttgtgatgactcggctcaatcagttcaaacagtttggctttgtccaattcgggaaaaatgaatttcagaccgtttgccgcacgtccgaactgtttttttacccattcaaggtagcggtcggctgaaatgaccttatcttccttaaccgcgtgtatgcgcgttgccttttgggcgaatcgttcgcaaatcggatatgcgccgccgaaatattcgcccggattctgcaaaacttcgaaagggataacgatgtcttttgctttgaattcaatttcaaatcgcgtccatgtgcttgttttatcgcccaactgcttgcctttttcatagacgcggacatatttggacgattcacgggagccgataccataggtcttgcctttggtcattttggcttcatcgtcttcttcccaatctgaccccaaacattcgccttttggtttgacgtgatgacaggtaaacatacctttatttcggtcttcacgggcttggttcgggctgtattcgccgttgaaaaagtcttttgcgatgtcaacgcgtgtgatttttgggcggattgcattagtcaggaatgcgaaaagtcgtgattcccagccttcttttgcgacgccgcaaccggtgccggtcagttcgaaaagaatggtattttgttggccgccaaaatggacgcgaccgtatagggcgtcttccgaacccatcaaccaacagcgctcatagaaacgaccgcccgaacctttggattctttgtagataccgaaaccgaaaacttcttcggcgagcatggacgcggcgcgaataaaatcttcgtcttccaaaagacttacacgaacgccgtatttatcgaaaaaggttttttcatgaaatgaaaagctaatttgatcaatgaaagccgaatctgatacaccgcgccgaagaggaacgcctaacaggtttcctttaccgtccgttatgtacgtttcgtaacattcgaagacttcctgaaccctgcctgccgtttcggtttctgtccccccctgttagataaggggggaagatttgaagcggttgtcggcttcctgccgtccgctagcgcgtccgtcatcacgccggcaaccgcctttgtcatcccttgcttatcttccatggtgcgaatcctcaaaaacgggcaaaaaaaagccctgttacttgtagaaagtaaaggacgttaatttttgttaatcgtcccttcttagggacgcaatatataagggacgcaatatataaggttttaaaacgctaagaacaaaatccgataacggctctgaagaagtaagtctttctttattgcacaagatagcaaacttccacggcattctcgccccacccgtgccgtccaagcctttttcaaagacatagatggttttcttggcaatcacttcgtcagtttggcggtcgataatccgtatggtcgcacctgccacccagtgcctgcgcagcttggaatcgacattgttttcgaacgttaccgcataacgggcggggtgtatatgattaaatatttgatttagcggaaaaatctttacctgaataccgaataatatcggaatggttgggttgcaggacatccacatagcggtattccccatcgctaaaaaatcctaggaaacgagcaataaaatttacgccttcgctggtctgtaaagccgcattgtcccacatcgggtctctggtttttgcatctgccgaaacggtacgctcaggtactaccttcaacagcataatcccttccacattgtccgccgtctggtaaatctttcccccgccgttttgcattgttcgttaaacacggcttcggcttctttgtattttctgtcccactcttcttgtgcctgtatttcttctttgatcgggccgaattgtttgggaataatccaaacaaacagcatcaggatagcggcggcggtcaggctgcctgaaaggattttgccggggttccgtttgggctttttataggcaaagcggacgagaaaccaaagcaacagcagcatggtgccccaatagccgattgagaataggatggccaaaccttctaggaaatggcgtaaatcgtttgtggtaaacatgggttgttcctgtggttaaatgtgcaggctgctttttgccgaaccttgccgcatctcaaaagcagcctgcgcttcagcgttgcgttacgcagtaaaataatgaatatttgtaacgacttgggtattttttgtcaatattcccgcctttcccttaacagctgccgcgctttccgttaaaattcctttacatatttatattgtttcctgtttctatattgccaaggttatacccgttatgtttttctccgccctgaaatcctttctttctcgatacattactgtatggcgcaatgtttgggcggtgcgcgaccagttgaaaccgcccaaacgcacggcggaagaacaggcgtttttgcccgcgcatttggaactgaccgatacgccggtctctgccgctccgaaatgggcggcgcgttttattatggcgtttgcgcttttggctttgttgtggtcctggttcggcaaaatcgatattgtggcggcggcttcgggcaaaacggtgtcgggcgggcgcagcaaaaccatccagccgctggaaacggcggtggttaaggcggtacatgtgcgcgacgggcagcatgtgaaacagggagaaacgctggcggaactggaggctgtgggaacagacagcgatgtggtgcagtcggagcaggctttgcaggctgcccaattgtccaaactgcgttatgaagcggtattggcggcattggaaagccgtaccgtgccgcatatcgatatggcgcaagcacggtctttaggtctctccgatgccgatgtgcaatcggcgcaggtgttggcgcagcaccagtatcaggcatgggcggcgcaggatgcgcaattgcagtcggctttgcgcggccatcaggcggaattgcagtcggccaaggcgcaggagcagaagctggtttcggtgggggcgatcgagcagcagaaaacagcagactaccgccgtttgcgggccgacaattttatttcggaacatgcgtttttggagcagcagagcaaatcggtcagcaattggaacgatttggaaagtacgcgcggtcagatgaggcagattcaggcggccattgcacaggcggagcagaatcgggtgctgaatacgcagaacctgaaacgcgatacgctggatgcgctgcgccaggcaaacgaacagattgaccaataccgcggccaaacggataaggcaaagcagcggcagcagctgatgacaatacagtcgcctgcggacggcacggtgcaggaattggctacctatacggtgggcggtgtggtgcaggctgcccaaaaaatgatggtgattgcgcccgatgacgacaaaatggacgtggaagttttggtattgaacaaagacatcggttttgtggaacagggacaggatgcggtggtgaagattgagagctttccctatacgcgctacggttatctgacgggcaaggtgaaaagtgtcagccatgatgcggtaagccacgaacagttgggcttggtttatacggcggtggtgtcgctggacaaacataccttgaatattgacggcaaagcagtgaatctgacggcgggcatgaatgtcacggcggagattaaaacgggtaaacggcgggtgctggattatctgttaagcccgctgcaaaccaaattggacgaaagctttagggagcgataggcggatccgtactgggcatttgttatccgccggttcggacatgcagactgcctgaaaccattgcccggatgacattgctcaatctaatgataatgcaagattacggtatttccgtttgcctgacactgacgccctatttgcaacatgaactattttcggctatgaaatcctatttttccaaatatatcctacccgtttcactttttaccttgccactatccctttccccatccgtttcggcttttacgctgcctgaagcatggcgggcggcgcagcaacattcggctgattttcaagcgtcccattaccagcgtgatgcagtgcgcgcacggcaacaacaagccaaggccgcattccttccccatgtatccgccaatgccagctaccagcgccagccgccatcgatttcttccacccgcgaaacacagggatggagcgtgcaggtgggacaaaccttatttgacgctgccaaatttgcacaataccgccaaagcaggttcgatacgcaggctgcagaacagcgtttcgatgcggcacgcgaagaattgctgttgaaagttgccgaaagttatttcaacgttttactcagccgagacaccgttgccgcccatgcggcggaaaaagaggcttatgcccagcaggtaaggcaggcgcaggctttattcaataaaggtgctgccaccgcgctggatattcacgaagccaaagccggttacgacaatgccctggcccaagaaatcgccgtattggctgagaaacaaacctatgaaaaccagttgaacgactacaccgacctggatagcaaacaaatcgaggccatagataccgccaacctgttggcacgctatctgcccaagctggaacgttacagtctggatgaatggcagcgcattgccttatccaacaatcatgaataccggatgcagcagcttgccctgcaaagcagcggacaggcgcttcgggcagcacagaacagccgctatcccaccgtttctgcccatgtcggctatcagaataacctctacacttcatctgcgcagaataatgactaccactatcggggcaaagggatgagcgtcggcgtacagttgaatttgccgctttataccggcggagaattgtcgggcaaaatccatgaagccgaagcgcaatacggggccgccgaagcacagctgaccgcaaccgagcggcacatcaaactcgccgtacgccaggcttataccgaaagcggtgcggcgcgttaccaaatcatggcgcaagaacgggttttggaaagcagccgtttgaaactgaaatcgaccgaaaccggccaacaatacggcatccgcaaccggctggaagtaatacgggcgcggcaggaagtcgcccaagcagaacagaaactggctcaagcacggtataaattcatgctggcttatttgcgcttggtgaaagagagcgggttagggttggaaacggtatttgcggaataaagcaggctgaaacggttatgaaattcccaaagcagcctgcaccccgtttcgaaagtgcaggctgctttgggattgatccgatattttcacattctcattgcctttaaataaagcacagttaaaaacacatttaaattaagtgcgaattaattcaaatgtatattcaattaaaatcaaaataggacagtagtgcatcgttaaatcgggcgtaatcagacaatacggttcgcagataccgcttaatattcgcccaaaccttctcaatcgggttgagctcaggtgaataaggtgcaagaggcaataccttatgtcccaatttttccgccatttcccgtaagacacccatacggtgaaatcgtgcattatctaaaataatcaccgatttttgagtcaatgcgggcagtaggcattgctgaaaccacgcttcaaaaaagactccggtcatcgtattttgataaaccatcggagcaatcagccggttgccgacttgtgcggacaccagagataagcgtcggtatctttttccacttatctgcgctttcactatttgccctttcaggctgcgggcatagggacggaacaggtggcggtcaaatcctgtttcatccaaataaacgcgttggtagtcagaaaattcggccggctgtgtcaaataatgcgttactttggccgggtcttgttctttgtaagtggtggtctttttttgcgcgttatccccatctgtttgagtgcatagcaaacggtggctgccgtacaatcaaaatgtttggcgatttcatgcagataggcatcctggtgttgcccaacatattgagccggtttttgcctatccgatttgacggcatttagaccggtaacttgatgttttaggctgcctgtttgttttttaaggcgaatccacaggtaaagtgtgtttcttgacaagttaaacgttgctgcggtttggctgatgtttttgcattgttcgtaatatagtggattaaatttaaaccagtacggtgttgcctcgccttgccgtactatttgtactgtctgcggcttcgtcgccttgtcctgatttttgttaatccactatagtttaaagctttgtttcttaagtccgcagagtatgccatggttagaccttcaaagttgagtattgtactattttgtttttaattgactatgcaacaaaaaatagcaaaccccggcaatcaaaatgccgtctgaagcgttattcggctttcagacggcatttttgtatttaaagccgggtaacgctcaatacgcctttgacgtcgccgaggctggcgaggacgcgcgggaggtcgttgacttgtttgacttcgagcgtgaacctcatgctggcttccaagtcgcgggactgggtttgcacggcggtaacgttgagtttgtggcgggcgagcgcgtcggatacgtcgcgcaaaagcccggagcggtcttgggcgcggatttcgatatcgacggcgaatacttgtccttcctgcaatgccgcccagcttgcgtccagcactttttcgggcgcgtgttcggcgaggtgttggaaagacgggcaggttttgcggtgcactgaaatgccgcgctcgcgggtaacgaagccgataatatcgtcgggcggcgcgggtttgcagcatttggcaagcgtggtcatcagaccgtcttcgccgtcgatgagcacgccgtttttgccgccttttttgattttggactgtttgacgatggtggtttcgctgacgggtacgggcggcggttcgttcagcgtgccgcaggctttttggatggcgcggttggaaatttcgccttgtccgacggcggtgtagaggtcttctggctttttgtagccgagattttcggcaagctcttgcaggttgggtttgggcgtgagtttggcaagctgtttgtcgagttggacgcggccttcttcgcgcacggtgtcggcgttttgctggcggatgtaggcgcggattttgccgattgccttgttggatttgacccagccttcgtaaagccagttgacggaaggatgcccttctttggcggtaatgatttcgacgcgctgtccgttttcgagcggggtggacagcggcacaatctgcccttcgactttcgcaccgcggcaacggtcgccgatgctgctgtgcagggcgtaggcgaagtcgatgggggtcgcgcccgtgggcagggagaggactttgccgtgcggggtcaaaacataaatcgtgtcgttgaaaagctcggttttgaaggcggcggcgaggtcttccttgccgctttccgccatgttttcgcgccagtccaagagttggcgcaaccaggcgattttctgttcgtaggcggaatcgcccttgccgccctctttgtaacgccagtgggcggcgacaccgaattcgttgaattggtgcatatcgaaggtgcggatttgtacttccacgcctttgtcttccgggccgacgatgacggtgtgcaaacttttatagccgttgcctttgggattggcgatgtagtcgtcgaactcgccgggaatgggctgccagaggctgtggacgatacccagcgtggtgtaacactcggggacggtatcaaccagaattcgcacggcgcggatgtcaaagaggccgtcgaagctgagttttttcttcaccatttttttgtaaatggagtagatgtgtttcgggcggccggcgacttcgaaatggacattgtatttcttgagttcaccgcgcaggatgttgaggaagttttcgatgtattcgaggcgttcggtgcgtttttcgtccaaaagcagcgcgatttcgcggtatttttcgggcttttgatggcggaagcccaaatcttcgagctgccatttgagctgccacacgcccaaacggttggcgagcggggcgaagatgtcgagggtttctttggcgacggcgcgtttttcggggctgtcgggggcgttgcttaaaaattgcagggtgcgcgtacgcatcgccagtttgattaacacgacgcggatgtcggtaaccatcgccagcagcattttccgcatagtttctgcctgctgggcgcgttcttccggcgtggcgaggctgtccacccgggcgaagtgggtgagtttctgcacttcgtccacacctttgaccagctcggcgacggtactgttgcagcgttcggaaaccaataggttccagtcggggacgtagcgtccgatgtcggcaagcagggtggcggcgacggcatcggggagcaggtcgagttcatgaaccatttgcgccgcgccgaggaagtggtcgggcagcggctcgccatacggcgtggcggcatcggcggggtaatgttcctgcgccagcaaccatgcggtaccgatgaggtttttatcgttgtccggcagagc

SEQ ID NO: 37845 - DNA, 5669 bp, Neisseria meningitidis
ccaggcttgggtctgcaccatgttgttttcctaaatattgctgcctttgaaaaactttaaaaccgccatcgaaatcaccgccgccggaatcgacgaggcaaacgtcagcccgactttcaaaccgaggtaaacattggacgcagtaaaaattacagtgatcaatgcaccgagtatcatgcctcggagcgtcagctcgcggtattcttctaccgaactggataaagatttattcattattcttcctttgacaacagacgttcacatattgttggcatcacgccatgatgtcaagttttaaaaagaacagttaaaaacagttatcccaccctgcctcataccccattgaaaataaaaactatttttaaacaaataaaaacagccgtatcaaggagattccccgatacggctgcttgtttccgaaccttaaaatcaatcaaacaaatcgcgcagcttgtctaaaaacgatttcttgcgcggtgtttggttttccaagccggtagaaatccgctcaaattcttccaaaagctctttttgacggtcggtcaaattgacaggcgtttcgacaacaatatggcagtacaaatcgccggtcgcgctgctgcgtaaagatttgacacccttacccttcacgcgcatcctcctgccggtttgggtttctttggggacggtgagcttgacctttccgtccaaggtcggcacttccaactccccgcccaaagcagccgtggcaaaactgatcggcagttcgcaatgcaagtccagaccgtcgcgttggaaaatcttatgcgcccgaatgcggacggttacatacaagtcgccggcaggcgcaccgtgcatacccggcccgccttcgccgctcaaacggatacgctgcccgtcatcgataccggcgggaatattgacttccaccgtcttgaccgccttattccgccccgcgccacggcatttgacgcaaggttctttaatgtgtttgcccgcaccgtggcaggtcggacaagtctgctgcatacggaaaatcgcctgctggatgtgcaccgtacccgaacctttgcaagtcgggcaggtttccggggatgtccccggtttcgcgccactgccgttacagacatcacacgcttcataagtcggaatattgatgcgtttcttcacaccttttgcggcttcttcaagcgtgatttcgataccgacttgaacgtcctcaccctgataatcaggctgggcgcgccccgaaccgcctccaaacatttggctgaaaatatccccaaagtcaaaaccctgcgcaccgccaaatccgccaaaccctccgaagcccccctgtccgccgccttcaaacgccgcatgaccatactggtcgtacatagcgcgcttttccttgtcggacaaagtttcatacgccttttgtacttctttaaacttctcttccgcctctttattgtcaggattgcggtcgggatggtatttcatcgccaatttccggtaggcttttttaatctcatcatcggtagctgttcttgccacacccagcgtcgcataaaaatcttgattactcattttttcatctaattcaaaataaaatcacggctcaaaataagggcaattgcgcaaaacacaagacaaacagactgccatagcttacaaactgaaacggaatacacttttcagacagcataaaccgatgccgtctgaaatcttcaggtatgcacgacacaaaaacttagataggcataaaaccaaccgccatgaagtgtttttgttataaaaacgccgcccgaacgcatgttcagacggcatttgatgcggctgcagacttccccctattttattttttatccgcgggcagcactggtttggctgggccttttggtgcgggcgcgccgacggaagcctgatccttcagcttcgccagcaccgcagggcctatgcctggcagcgcctccaactcctgctgcgaagccgcattgatgtttaccgccgcaagggagaaggcgcaggagaacagcatacagaacagcacgaacattttcttcatggtttttcctttaagggttgcaaacaataaaccgcatcttgcgacgataaaacgagtcattctaaaatgaatatcccaaagtttcaagccgttcctccgcaaacccgaccggacaccgtacggatgccgtcccgccatcaccgacattttttccgggcaaagcaaacattttttccgggcaaagcaaaaacccccgaataatcgggggttttctgaatgggtgtttggcagtgacctactttcgcatggaagaaccacactatcatcggcgctgagtcgtttcacggtcctgttcgggatgggaaggcgtgggaccaactcgctatggccgccaaacttaaactgttacaaatcggtaaagccttaatcaatatattcggtaatgactgaatcagtcagtaagcttttatctcttgaagttcttcaaatgatagagtcaagcctcacgagcaattagtatgggttagcttcacgcgttaccgcgcttccacaccccacctatcaacgtcctggtctcgaacgactctttagtgcggttaaaccgcaagggaagtctcatcttcaggcgagtttcgcgcttagatgctttcagcgcttatctcttccgaacttagctacccggctatgcaactggcgttacaaccggtacaccagaggttcgtccactccggtcctctcgtactaggagcagcccccgtcaaacttccaacgcccactgcagatagggaccaaactgtctcacgacgttttaaacccagctcacgtaccactttaaatggcgaacagccatacccttgggaccgactacagccccaggatgtgatgagccgacatcgaggtgccaaactccgccgtcgatatgaactcttgggcggaatcagcctgttatccccggagtaccttttatccgttgagcgatggcccttccatacagaaccaccggatcactatgtcctgctttcgcacctgctcgacttgtcggtctcgcagttaagctaccttttgccattgcactatcagtccgatttccgaccggacctaggtaaccttcgaactcctccgttacgctttgggaggagaccgccccagtcaaactgcctaccatgcacggtccccgacccggatgacgggtctgggttagaacctcaaagacaccagggtggtatttcaaggacggctccacagagactggcgtctctgcttctaagcctcccacctatcctacacaagtgacttcaaagtccaatgcaaagctacagtaaaggttcacggggtctttccgtctagcagcgggtagattgcatcttcacaaccacttcaacttcgctgagtctcaggaggagacagtgtggccatcgttacgccattcgtgcgggtcggaacttacccgacaaggaatttcgctaccttaggaccgttatagttacggccgccgtttactggggcttcgatccgatgctctcacatcttcaattaaccttccagcaccgggcaggcgtcacaccctatacgtccactttcgtgttagcagagtgctgtgtttttaataaacagtcgcagccacctattctctgcgaccctccggggcttacggagcaagtccttaaccttagagggcataccttctcccgaagttacggtatcaatttgccgagttccttctcctgagttctctcaagcgccttagaattctcatcctgcccacctgtgtcggtttgcggtacggttcgattcaaactgaagcttagtggcttttcctggaagcgtggtatcggttgcttcgtgtccgtagacactcgtcgtcacttctcggtgttaagaagacccggatttgcctaagtcttccacctaccggcttaaacaagctattccaacagcttgccaacctaaccttctccgtccccacatcgcatttgaatcaagtacaggaatattaacctgtttcccatcgactacgcatttctgcctcgccttaggggccgactcaccctacgccgatgaacgttgcgcaggaaaccttgggctttcggcgagcgggcttttcacccgctttatcgctactcatgtcaacattcgcacttctgatacctccagcacactttacaatgcaccttcatcagcctacagaacgctcccctaccatgccggtaaaccggcatccgcagcttcggttatagatttgagccccgttacatcttccgcgcaggacgactcgaccagtgagctattacgctttctttaaatgatggctgcttctaagccaacatcctggctgtctgggccttcccacttcgtttaccacttaatctatcatttgggaccttagctggcggtctgggttgtttccctcttgacaacggacgttagcacccgctgtctgtctcccgaggaaccacttgatggtattcttagtttgccatgggttggtaagttgcaataaccccctagccataacagtgctttacccccatcagtgtcttgctcgaggcactacctaaatagttttcggggagaaccagctatctccgagtttgtttagcctttcacccctatccacagctcatccccgcattttgcaacatgcgtgggttcggtcctccagtacctgttacggcaccttcaacctggccatggatagatcactcggtttcgggtctacacccagcaactcatcgccctattaagactcggtttccctacgcctcccctattcggttaagctcgctactgaatgtaagtcgttgacccattatacaaaaggtacgcagtcacaccactagggcgctcccactgtttgtatgcatcaggtttcaggttctgtttcactcccctcccggggttcttttcgcctttccctcacggtactggttcactatcggtcgatgatgagtatttagccttggaggatggtccccccatattcagacaggatttcacgtgccccgccctacttttcgtacgcttagtaccgctgttgagatttcgaatacgggactgtcacccactatggtcaagcttcccagcttgttcttctatctcgacagttattacgtacaggctcctccgcgttcgctcgccactacttgcggaatctcggttgatttcttttcctccgggtacttagatggttcagttctccgggttcgcttctctaagtctatgtattcaacttaggatactgcacagaatgcagtgggtttccccattcggacatcgcgggatcattgctttattgccagctcccccgcgcttttcgcaggcttacacgtccttcgtcgcctatcatcgccaaggcatccacctgatgcacttattcacttgactctatcatttcaagaacttctttgactttgcctaacattccgttgactagaacatcagacttgaatttcctactttgataaagcttactgctttgttgtgtcttaatcctgccttttgtgtttcaggattaagtcgatacaatcatcacccaaatactgtgtttgttttcttttctcttgcgagagatttttatcctttgcaaagaataaaaaatcaaaacaaacgctttgtctttgtttgttgatttcggctttccaatttgttaaagatcgatgcgttcgatattgctatctactgtgcaaatcaaatcgagctg

SEQ ID NO: 37846 - DNA, 9243 bp, Neisseria meningitidis
catgctgaacgtttggctgacataaagttaaatgagtcagtccgctataattgatgaaacgggttaaaaaagtgttgccatcgcctgttcttcttgtcggatacgcttaaataagaccagcaaataaatgggcaggccaatcaataaaacataccacgcttgacataataaggcgatgccaatcagttcgggtatgatgtttaaaaaataattggggtggcggaatgttttaaacaaccacgaacgattaatttgatgatttggtaaaatatagattttaaccgtccaaatctcccccaactgcttaataatcaatgacaatatcacaaacgaagccatcaccgtcagcgtaccaatcaaggatatgccattaaaagcagtgtcagaaagccatacccaaacaaaacacgccaaataataaagcgtatgaactgccgcaagcagcgtggaattggtttttccgtattgtttcgcccctttggcaatcaaggctttttcatgtttaatagagacggctaaaaataacagtctgatgataaaaaacaggcttaaaatgcttaaaatcattgtcattgatgtttttccattgaaattgaaataaatataaatcggattaatggtatttttaattaatgatgtttcagaccatcatgctctataaacaattcccattaagtccgcgccgcaacctgctataataagtctgcaatcggcgcaaatcaatgctttgcgtttattgccatcccaaaataattgatgctgccttaattataataccaagataagtttttttattcaataaaatacaaagggaagcgttcagcccattgcaaacagatgcaatccaccgattatttaaaaaacggcaaagccttgccccccttgcggcaagcctgcaatgcctttaatgtccgcaggcgcaagcgtcgccgtggtgcccgcaaccctgtgccgtttcgagccattcgtcgtcatcgccgtcaaactcttccacttcgtcaaactcgccgcgttccaccatgacgcacaactcttcaaggctttccgcgccttccacccaaaaacagggaatgcccggcggcatatcgggcgcaagcagtgccgctacgccttcatgccacgcaatccaatagccgttgtccgtacggacgaattgtgcgttttcgttgaccgactcgccttccgtaccttccagcatacgttccgcaatgtccggttgaaaagataaaatctgcataagtgttcctttatatgatggttttccgtcaaaacaaggtgttatagtggattaaatttaaaccagtacggcgttgcctcgccttgccgtactatttgtactgtctgcggcttcgtcgccttgtcctgatttaaagttaatccactatattttaaaacatcgcgcccgcttgagaaactgccaaccgctttataacaaattcgtctttgcaccaaactttccattctttccgtttttcggacggcatcgttaaagtagtccttccttttccttattttcagcattgttttatgttagcgctcaaaacgcccggcgtactgcccggcttcaaactcagccttggtctgaccgtattgtgcctgtcgctgcttgtggtcttgccgtttgcgatgatggcggcgaaggcggcggaaatcggctggggcggcttttggaacacgattgccgagccgaacgtgttggcggcggtatggctgagcttgcggatgtcgttttatgcgatgctgaccaatgtcgtgttcggcacgctggtggcgtgggtattggtgcgttatgaattcccgggcaagggtctggcgaacgcgctggtcgatttgccgtttgcgctgccgacggcggttacgggtatcgcgttggcaaccctgtatgcgcccaacggttggataggccgttttttcgagcctttgggcatcaaaatcgcgtttacacccgtcggcatttggattgcgctggtcgtcgtcagcctgccctttatcgtccgcgccgtgcagccggtattggaagaattgtcgggcgaatatgaggaagcggcggcaactttgggcgcaagccgttggactacgtttcgccgtgtcctcttgcctgaaatcacaccggcactcttgaccggcgcgggaatgatgtttgcgcgggcaacgggggaatacggttcggtgatttttatcgcgggcaacattccgatggtttctgaaatcctgccgctgattattacgggcaagctggaacagttcgacgtgcagggcgcgtcggcggtggcgttgtttatgctgctggtttcgtttgtgattctgtttgcgctgaacgtgatgcagtgggcgttgggcaggcgttcgggcgcgaagggttgaggtcgtctgaaatacctgttaccgtcattcccgcgcaggcgggaatccattggtgaatttcggctgccttatttattttctgttttcctgttgccctgcggtggattcccgcctgcgcgggaatgacggtagctagacgtttttattcccttaatcaataaaaggttgtctgaaaacgaatccgccccacaaaaaacggtttttcagacggcatccaaacattttaaaaccaaccagagaacaccaccgccatgaaaccctattccgccaatcccaacctgaccgaaccgcgccggctgcgcgtgttgctgattgccgccgcgctgggctttctgctgctgatgctggtcgtgccgctcgtcgccgtgttttacgaagccttaaaaggcggttgggatttgtacctgaaatccttaaacgatcccgaagcgtggtctgccatcaaattgacgctgattaccgcgctgattgtcgttcccgtcaatgccgtattgggtgtggcgatggcgtggctgctgacccgttttgattttcgcggcaagcagttgctgaccaccctgctcgatttgccgttttccgtatcgcccgtggtggccggtttgatgttcgtcttattgttcggcgcgcatacggcattgggtggctggctcgaagcgcaaggcatacagattatcttcgccatccccggtattgttttggcgacgctgttcgttaccttcccctttgtcgcacgcgaaatcatcccgctgatgcaggcacagggcgacagcgaagaacaggcggcattgatactcggcgcaagcggctggcagatgttttggcgcgttaccctgcccaacatcaaatgggcgttactctacggcatcatcctcaccaacgcccgcgcgatgggcgagttcggcgcggtcagcgtggtatcgggacacatacgcggcgaaaccaacaccgtcccgcttttggtcgaaatcttctacaacgaatacaacttcaccggcgcattcgccctctccggcgtattggcacttttggcactggcgacgctggcggtgcagaacatcattaccaaattacaagacaaaaaactcgccgccgccgaaaggaatgcaatatgagtatcaccatccaaaacttaaacaaacacttcggcaattttcacgcgctgaaaaacatcaacctcaacgtccccaccggcaaactcgtttccctgctcggcccgtccggctgcggcaaaaccacacttttacgcattatcgccggactggaaaacgccgacggcggcaatatcctgtttgacgggcaagacgtaaccgccaaacatgtgcgcgagcgcaaagtcggcttcgtgttccaacactacgcccttttccgccatatgaacgtgtttgacaacgtcgctttcggtttgaccgtattgcccaagtccgaacgcccgtccaaaggacaaatccgcgccaaagtcgaagaattactcaagctcgtgcagctctctcatttggcaaaatcctatccgcaccaactctccggcgggcaacgccagcgcatcgccctcgcccgcgcgcttgcggtcgaacccaaactcttgcttttggacgaacccttcggcgcgttggatgccaaagtacgcaaagaattacgcacctggctgcgcgacatccatcacaacctgggtgtaaccagcattctggttacgcacgaccaagaagaagccctcgaagtttccgacgaaatcgtcgtgatgaaccacggcaaaatcgaacaaaccggcagcgccgaagctatttaccgcaaacccgaaaatgccttcgttaccgagttcctcggcgaaaccgacgcttttgaaggacgcatcgaaaaaggcttctggcattacaacggcttcgcgtggaaattggacgcgcaatacaaatggcaggaacaaaccgccaccggctatatccgcccgcacgaatggcagatcgccgccgaacacgaaacaccgatgatttgtgccgaaatcgaaaaaatccacgccgtcggcgcattgacgcatattctggtaaaacacgacaaacaggacgtacatatcacgctggcaggcagcgatgccgcgcgttacccaatcgccgaaggcaaagaattgaagctgattccgaaacaggtttatgtcttctctcaaaacgaactgattgaatattcgatttaaccatgaaagcgcaatgccgtctgaaaggctttcagacggcattgtgctttcaagcgtcaggcaagaaacagcttgtacgcggcattttgcgtttcctcgtgatagctgtatcccagactttccaagaaaccgtcaaatgcggcggcatcgtgcggcggcacatcgataccgaccaaaatccgcccgtaatccgcaccgtggttgcggtaatggaaaagcgtaatattccaccctccctgcatatggttcaaaaagcgtgccaatgcccccggacgctccggaaactcaaaactgaccaaacgctcgttttctactttgtccgtccgccctccgaccatatagcggatatggattttggcaatctcattgttggtcaaatcgacattgggcaatcccgcctcatccaaccggctgccgataaccgccaaatcctgcgggcctgccgcttgaagtccgacaaagatatgcgctttttcatcgtctccgtagcggtagttgaactcggtaatattcctatttcccaatatattgacaaacttaaggaagctgccgcgttcttcagggatggtaacggcaaaaataccttcgttgccctcgcccaattcgctccgttccgaaacgtggcgcaaacggtgaaaattcatattcgcaccgctggtaacggcaatcagggtttggttttccgcgccttctcgggcgatataggctttcagacccgccaacgccaacgcgcccgccggctcggtaatgctgcgcgtgtcatcgaaaatatccttgaccgcgccgcaaaccgcatcggtatcgactgtaatgatttcatccaaaagttctttgcagaggcggaaggtttcgtttccgacgactttgaccgcagtgccgtctgaaaacagcccgacatctttcaaatggacgatttcacccgcttcgaccgactgcttcatacagcaggaatcgttggtctgaacgccgataactttgatttcgggacggacctgcttgataaatgccgccacgcccgccgccaaaccgccaccgcctatcggtacgaatacggcgcggattggatcgggatgctggctgacaatttccatccccaccgtcccctgtcccgcaatcacatcaggatcatcaaacggcgcgatataggttaacccttctttttccgccaactccatcgcataatcgtaggcatcgttgtatgaaacgccccgcaaaaccacctcgccgccatggcttttaaccgcatccactttgattttcggcgtagtctccggcataacgataacggcacggcagcccaaacgctgtgcggacaatgccacgccttgagcatgattgcccgcgcttgccgcaatcacgccgcaagcgagcgcatctttcggcaacttggacattttgttgtacgcgccgcgtattttgaacgaaaaaaccggctgcaaatcttcgcgtttcaaaaggatgttgtttttcaaacgtacagaaaggctgcgtgccggttccaaaggcgtttcgaccgccacatcatagacagatgccgtcaggatgcggatgaggtaatcggaataaggaaggggcgtgttcataattcaatatgggataatcggtttattaaaatcgcaaaacccaaaaccatacgcccaagacggcgcgaaatcaagaaaaatccgcccgatcagacaccctaagcgtataatcggcagactgaaacacgcacacaattagaatatttcatgacagcacataaaatcctgcccgtcctgctttccatcatcttaggcgtttctcacgcaacggctgcatcgcccgcgcccaacagaccgacggtacacgccgcccccacgttccaaacacccgaaaccctcacagcggcacacatcgttatcgaccttcaaagcaaacagattttatccgccaaaaacatcaatacccctgttgaaccggcggcactaacccaactgatgaccgcatatctggttttcaaaaacatgaaatcgggcaatatccaatctgaagaaaacttaaaaatacccgaatccgcatgggcttcagaaggaagcagaatgtttgtacgtcccggcgatacggtcagcaccgacaaactcttaaaaggcatgattgcactatccgcaaacgatgccgccctaacccttgccggccggctgggcaacggctcgattgaaaattttgtgcaacaaatgaacaaagaagcccgacgcttgggcatgaagaacactgtattcaaaaacccgacaggcttgagtagagaaggacaggtttccaccgccaaagacctcgccctgctgtctgaagcattgatgcgcgactttccggaatattacccgctgttttccatcaaatctttcaaattcaaaaatatagaacaaaacaaccgcaatatccttttatatagggacaacaatgtaaacggtctgaaagccggacacacagaaagcggcggctacaaccttgccgtgtcatactccggcaacggcaggcacatccttgtcatcacattgggttcggaatcggcggaaacacgcgcatcagacaacagcaagctgctgaactgggcattgcaggccttcgatacgcccaaaatatatccgaaaggcaaaaccgttgcccaaatccaaatttccggaggcagcaaaaaaaccgtccgcgcaggcttcctcaaagaagcctacatcactctgccacataaggaagcgaaaatggcagaacaaattctagaaaccatacagccgattcccgccccagtaaaaaaagggcaaattttaggaaaaatcaaaatcagacaaaacggatacaccattgccgaaaaagaaatcgtcgcactggaaaatgtaaaaaaaagaagccggtggcaaaggctttgggcgtgtctgacagggcagtaatctgccgtttcaaatatcccgtttttccaacaaataaagaaatgccgtctgaaacacggttcagacggcataaaacaacagggcggtacgtattgcatacgcgccgccctgctgctgaaatcaattagcgtttcttaccggtaacggtagcaacagccagattttcgttacgtttcagggaaacgctttctacaccttcaggcagtttgatgtctgacaagtgcagaatgtcgccggcaaccacttcagcacaatccaaatccaagaaagcagggatgttggcaggcaaagcaactacttcaacagaagtgtttaacagagatacgcggccgccttgcagtttgaccgcttgggaattttcagcgttaacgatgtgcaggggaacacggatgcgtacaagttgatcggctttcacagcttggaagtcgatgtgttgaacttcgcggcggaacgggtgcatttggaaatcacggacgataacgtctttggtttcaccgttcagagacaacttaatcaacgcagtatggaaagattctttttccaatgcgtagaatacggttttgtgatccacagcgattgcaacaggctcttgaccttcaccgtacagaatgccggggatttggccttcgcgacgcaggcggcggctcgcaccagtgccttgtgcttcacgaacagaggcttgaatttcataagtcatgttaaatactccaagttaggtaaaatcgccgtcatcggccgcgaccagcttaagacggcttcgggcttatggcagcaacatgctgcctgtcatcacttcttcattgaaaagatatgagacggattcttcattgctaatgcggcggacggtttcggccaacagaccggcaatcgttacctgacggatacggtcgcagtttttagccgcttcagacaaaggaatggtatcggttacgaccacctggtcgatttcggatgaggcgatacggctgaccgcctctccggagaatacggcgtggctggcataggctagaacacgttcagccccccgctctttcagggcgacggcggctttgcacagcgtatttgcagtgtcaatcatatcgtccacaatcagacaggttctaccttgaatatcgccgatgatgttcatgacttccgccacattggctttcgggcggcgtttgtcgatgattgccaagtcggcattcagggattttgccacggcgcgggcgcggacgacaccgccgatgtccgggctgacgacggtcagattttcaatccgctgttgtttgatgtcgttcaacagaatcggggtggcataaatattgtccaccggaatatcgaagaaaccttgaatctggtcggcatgcaaatcgacagtcaaaacacggtcgatccctgccgaatacagcatatttgccaccagtttggcagaaatcggaacgcggacggaacgcggacggcggtcttggcgcgcatagccgaaatacggaatggctgtggtaatacgacctgccgaagcacgcttcagtgcatccgccatcgtcaggatttccatcaggttgtcattggtcggcgcacaggtcggctgaaggatgaaaacatcgcgcccgcgtacgttttccaacagttcgacggcaacttcgccgtctgaaaacttggatacggaagcattgcccaaagaaatgtccaaatgcctgacaacacgttgtgccaattcgggattggcattgcctgtaaataccatcaaactgtcgtacgcagccatattctcacctgattttatgtttaacttccgctcagaaaacacaatgcttc

SEQ ID NO: 37847 - DNA, 529 bp, Neisseria meningitidis
gcaggtcgactctagaggatccccagcaaatggggcaaggttcaaataggaacaccatctgcagattttggcattatcactttagatagtggcgatggatatgccgtttcatgccatcatcccgaaatttttacgctaatcctaaaagaagaaggattggatgaagatttcaaaatcggtatcgaagggcgctctcatcgcgattgtgatgctgaagaacccaaagttatccatatcgaagataaacgcaccattgaaaccccatgaaaacctgctgccgtttaatcatctactgatgattacttaggcaaatgtgcccgtccctcccttttcagacgacctttcattgcggaaaccgccgcaaaggttgtctgaaaaccgttttccatccccgttttacaaacaaaccgaaagccccacatgatctctttgaaaaacgacactttcctccgcgccctgctcaaacaacctgtcgaatacacgccgatttggatgatgcgccaggcggggcgttatctgcccgaataca

SEQ ID NO: 37848 - DNA, 7919 bp, Neisseria meningitidis
cggcgaagcgcgccgcgaaatcgccgactttttaattgatgccgccgccttcaggcgaaaaatgggtcttgaacggaaagccggtaatgttgtcctatccgaaatgttccaattttgagcagatcaaacagggttcttatgtcggttcgacggttttaattctgttcgtagtcatttacggcttcaggcttttgattaattttttaaaagacatgggcaaggttgggattgattgatggttattgatttttggtttcttctcggtttcttcttggctttgtctgtcgctttgatatttaaatgacgtgttttaaaatcaggctttcaaaacaacctttgaaaggcagaacaatgaacaaaccgtttatcacgcaggcgcagttggcactttataaatatcagccgtcaagcaagtattatggtaaaacaatggcatatactttcgctagtgagcttttggattattcaaaagttaataaatttataattcatgaagaaatccaatgttttttaaatagaaggatttctaataatatttggaaaatttatttttctgatgagtctgttgcgtatataaaaattttagaattacaggatgattatagtcgtggaattgaaattaaaacgtttgattttaatcctaatgttggggatgttttcggttaattcttatgctgaacgttttaagtatcctattggaaattcagatgttagattggatattgatcataaaaaatctgtagttaccgattttcgtgttgatggtcagcgtttttcaggtcgaattatcgaaccttcaataatagaacacgtgccaacaggtgcacgctctcttgaaaaagtccccgttaaatttaccgcatcagtttcccgcgccgccgtcttgtcaggagtcggcaaacttgcccgcttaggcgcgaaattaagcacaagggcagttccttatgtcggaacagcccttttagcccatgacgtatacgaaactttcaaagaagacatacaggcacaaggctaccaatacgaccccgaaaccgacaaatttgtaaaaggctacgaatatagtaattgcctttggtacgaagacaaaagacgtattaatagaacctatggctgctacggcgttgacagttcgattatgcgccttatgtccgatgacagcagattccccgaagtcaaagaattgatggaaagccaaatgtataggctggcacgtccgttttggaattggcataaagaagaactgaataaattaagttctttggattggaataattttgttttaaatcgttgcacatttaattggaatggcggagattgtttggtcaataaaggtgatgatttcagaaatggggctgatttttcccttattcgcaattcaaaatacaaagaagaaatggatgccaaaaagctggaagagattttatcgttgaaagtcgatgccaatcccgacaaatacataaaggcaaccggttatcccggttattccgaaaaagtagaagtcgcacccggaacaaaagtgaatatgggtcccgtcacggacaggaacgggaatcccgttcaggttgtcgcaacattcggcagggattcgcaaggcaacaccacggtggatgttcaagtaatcccgcgtcccgacttgacccccggaagcgcggaagcaccgaacgcacagccgctgcccgaagtatcgcccgccgaaaaccccgcaaacaacccgaaccccaatgagaaccccggcacgagccccaatcccgaacccgaccccgatttgaatcccgatgcaaatcccgatacggacggacagcccggcacaagacccgattcccccgccgttccgggacgcacaaacggcagggacggcaaagacggaaaggacggcaaagatggcggccttttgtgcaaattcttccccgacattctcgcttgcgacaggctgcccgagtccaatccggcagaagatttaaatctgccgtctgaaaccgtcaatgtagagtttcagaaatcaggaatctttcaagattccgcacagtgtcccgcacctgtcactttcacagtgactgtgcttgattcaagcaggcagttcgcgttcagctttgagaacgcatgtaccatagccgaacggctaaggtacatgcttctcgcccttgcttgggcggttgccgcctttttttgtatccgcacagtatctcgtgaagtctagcaggcgcagcaccgccgggcttcagtaacttgtaccaaggcagggggaggacgtccagaaagatttgtaaagacggctttatcgtctttataaatctttttggataccccttgccgccccgccaaaagaacacattctgccgcaagggcaggtggtaaggcgcgcgccttttgcgccgtccccatgcccccgcggcgtcgcaagtgagactagggggtgtgggggactagtcccccgcaaagcgttcagcttcggaaactttggccgaaaggcaggcgaagcagcgcactttgcgacgaatgtcgcaaatagccgagaagcgcggggggattggcgataagcgcgaggggggtgtccccacagcgccgccgcgccgcgaatgcggcgcaaaatctttcagattaagaaacatttgtttaatgaggcaaccgtgccttttaagaaagggatagcaaatgaaattgttggccgcattgattccgcttttgatgagcgtggcaggccgtatattgactgcattaggcttgatggcggtaacctattcaggggtggatagattggtagcccattttcagcaggcgataaccaatagcataacgggcgcgcctcaagcgatgttgcagcttttttatataagcggcggtggaaccgttcttaatatcctgtttggcgcgatcgcctttattctgtcattcaaacaaatgacaaaactagcaacctcaatcgggaagaaaaaataaatggcagagatctgtttgataaccggcacgcccggttcagggaaaacattaaaaatggtttccatgatggcgaatgatgaaatgtttaagcctgatgaaaacggcatacgccgtaaagtatttacgaacataaaaggcttgaaaataccgcacacctacatagaaacggacgcaaaaaagctgccgaaatcgacagatgagcagctttcggcgcatgatatgtacgaatggataaagaagcccgaaaatatcgggtctattgtcattgtagatgaagctcaagacgtatggccggcacgctcggcaggttcaaaaatccctgaaaatgtccaatggctgaatacgcacagacatcagggcattgatatatttgttttgactcaaggtcctaagcttctagatcaaaatcttagaacgcttgtacggaaacattaccacatcgcttcaaacaagatgggtatgcgtacgcttttagaatggaaaatatgcgcggacgatcccgtaaaaatggcatcaagcgcattctccagtatctatacactggataaaaaagtttatgacttgtacgaatcagcggaagttcataccgtaaataaggtcaagcggtcaaagtggttttacactctgccagtaatagtattgctgattcccgtgtttgtcggcctgtcctataaaatgttgagcagttacggaaaaaaacaggaagaacccgcagcacaagaatcggcggcaacagaacagcaggcagtacttccggataaaacagaaggcgagccggtaaataacggcaaccttaccgcagatatgtttgttccgacattgtccgaaaaacccgaaagcaagccgatttataacggtgtaaggcaggtaagaacctttgaatatatagcaggctgtatagaaggcggaagaaccggatgcgcctgctattcgcatcaagggacggcattgaaagaagtgacggagttgatgtgcaaggactatgtaaaaaacggcttgccgtttaacccatacaaagaagaaagccaagggcaggaagttcagcaaagcgcgcagcaacattcggacagggcgcaagttgccacattgggcggaaaaccgtagcagaacctaatgtacgataattgggaagaacgcgggaaaccgtttgaaggaatcggcgggggcgtggtcggatcggcaaactgaagaaaacggcaagagagaaaaaagacccgtaaaccgtttgaatatagacggtttacgggtctttgtttcgcgcaaagcaagggctaaggcagtcaggcagcaaatcccgcaatgtattaaaacagacgcgtagaaatgccggctgcctttatccatcctcgaaattgaatatcatcctagccgtatcaaggctgtataaataaggaaaataccaatgaatataatcgggctggacatctcaaaggacaccatagacgcaacattgcataaaacaaacggaagtatccattacattaaatttaagaataatgatgatggattaaaacagtttagattgtggataaagggaaacagaatcagaaaagtctatatcggcatggaggcaacaggcatctattacgaaaaggcagcagatatgctttcttcctactatactgtttacgttattaatcccttaaaaatcaaggactacggaaaaagcaggtttaaccgtaccaaaaccgacaaagcagattcaaacctgatagcagactacataaaaaggcatcaagatacattgataccgtatcagatacccaaaaacaaagcactgcaaaaactgattaaccttaaaaatcaattacatcaacatcagaagcaaattaaaaaccgtcttcatagcactgaagaagacttcataaggaacatacatcaagacttgatagataccatacaggacaagatggaacaggtaaaaatagccatatccgaacaaatcaaaaaacaaacggacaataaccattaccgcaatcttcaaaccatcccgagcataggcaaagacaccgcatcagttctttatgcgcaactgacagaaaaacattttaaaaccgcaaaccagtttgtatcctatgccggattaaatcccgccatcatacaatcagggacaagcgtaagaggtcggggcagattgagccgatacggaaacagacgattaaaaagtacgctgtatatgcccgccctttgtgcttaccgttttaacgcatttccgaaattaataaataatctgaaaaaagcgggtaagccaaagatggtaatcatcgttgccatcatgcgcaaactggcgaagctcgcctattacattgttaaaaccggccagccttacgatgcggaaagacaccgattgaatcaataaaattcaacaaaattaaacggttacgcgaatatatttgtgtaaccgtgcatttgcatatcgtaaataaacgtaaataaaaataacaatataaatcagtatattgcaactttgttttttattttgtgttgacgggcaacatatcatctgcgcgggaatgacgggattttaggtttctgattttggttttctgtccttgtgggaatgacgaaaagtggtgggaatgacgaaaagtggtgggaatgacgtttcagttgctgcggttattgtcaggtttcggttatgttggaatttcgggaaacttatgaatcgtcattcccgcgcaggcgggaatctagaatttcaatgcctcaagaatttatcggaaaaaaccaaaacccttccgccgtcattcccacgaaagtgggaatctagaaatgaaaagcagcaggaatttatcggaaatgaccgaaactgaacggactggattcccgctttcgtgggaatgacgggatgtaggttcgtgggaatgacgaaaagttgcgggaatgacggaaagtggcgggaatgacggaaagtggcgggaatgacggaaagtggcgggaatgacggttcgggcattccttaaattacccgtgtatcgctgtaaatcttagagatggcggaatatagtggattaacaaaaaccagtacggcaaggcgaggcaacgccgtactggtttttgttaatccactataattgaaggggttatcggcttgtgcaacggaagcccaagttgtgcaagacatatttggattgcaggctggtacggatgccgtagcggaggaaggcggcatagttggacgagtcgctcgacccgatagacgcgccgctgcaaaacatttgcgcgttggcattgccggaagaaagcaggctgctgttgaaatcttccgtccattcccaaatcagcccgtgcatatcataaacgccccagtagttcgggcggcctttgccgacatcgtgcaggcctttccgtccgccgtcggcataccaatcgagaatagtgcggttgtagccgggttcgtttgagccgtttttctgcgtggcggaagcaagtccggcaaattcccattcgtcaatggtcggcaggcgtttgccttgtgcggcgcaataggcgttggcggcaaaccaggaaacattggttaccggttgttttaattcgcccgccttcggcgcatagctgcggctgccgtttttcatccaatgcttcaggtaagcgggttctgcctgtttggaaccgatcctgcctttttgccattgggggtggctgttgacaaattcggcaaactcggcattggtaacgggatatttatccagtttgaacggtttgactttaatcaggccggtatcttttttcagataaagcgggcggtagctgccgccttcgatttgaaccatttcggcagccgccgcttgagtgccggcgagtgccgcgccgaggaaaaataaccggacatacttcataaagcctcctgacaggcggttaaaatcaatcttccgaaaggaaagattggttgttaaaaaaccaccgccgtgcgtaatgaagtacagcggcagtggttcgtcccgctaatgacgggtatccaatttaataaacgcttttttcggatgcagaggctgccggggcagaagctgcgggagcggaagcagcaggagctgcaccgttaccggcgtaagcggtatcactcaatttttgagtcatgatttcagggttttctgcaccttctactttcaattgacccagtgcgcctttgttgaatgcgcggaagatagagtggtcaaccaaagtgtagctgcccgggatgtcgactttgaattcgacgatggcagagccgccggcaggaacgatggtgctttgtacgttttcgttaatcagtttgccgccttcaacataaactttgtcgaagatttcgccgatgacgtggaaggaagataccaagttcggaccgccgttaccaacgtacatacgtacagtttcgcctgctttggctttcagcgcgttatcgccggcgatagcacctacgtgaccgttgaatacgacgtattcaggctgttcggcaacggctttgtccatatcgaacggttgcagaccttgcgcgccttttttgcctttggtgtagaagtcgccttggacgatgtagaactctttatccactttcggcaggccttctttaggctcgaccaaaatcagaccgtacataccgttggcgatgtgcataccgaccggtgcgacggcgcagtggtagatgtacagacccggttgcagggctttgaagctgaatgtggaagtacggcccggagcggtaaaggttgcggccgcgccgccgccctggccggtagccgcgtggaagtcgacgttgtgcggaacggtagaagaaggattgttggaaaattccacttcaaccgtatcgccttcgcgtacgcggatcatacggcccggaacgtcgccgtcaaatgtccagtagcggtattccacaccgtcttccatggtcatggttttttcgacggtttccatttttacgcggactttggcggggtagtcgcggtcgattgcaggaggcacttcgggagcgtgggtggtaaccgcatcgataacgggcagttcgc

SEQ ID NO: 37849 - DNA, 4156 bp, Neisseria meningitidis
gtcgactctagaggatcccctgcggatttattacgatattaccgtattcaggccgcaccgatgccgcctgccccccgaaaaactttggagaatccaaaaaatgtttcattttgcatttccggcacaaactgccctgcgccaagcgataaccgatgcctaccgccgtaatgaaatcgaagccgtacaggatatgttgcaacgtgcacagatgagcgacgaagagcgcaacgccgcctccgagcttgcccgccgtttggttacccaagtccgcgccggccgcaccaaagccggcggcgtggatgcgctgatgcacgagttttcactctccagcgaagaaggcatcgcgctgatgtgtctggcagaagccctgctgcgtatccccgacaacgccacgcgcgaccgcctgattgccgacaagatttcagacggcaactggaaaagccatttgaacaacagcccttccctcttcgtcaatgctgccgcctggggcctgctgattaccggcaaactgaccgccacaaacgacaaacaaatgagttccgcactcagccgcctgatcagcaaaggcggcgcaccgctcatccgccaaggcgtaaattacgccatgcggcttctgggcaaacagttcgtaaccggacagaccattgaagaagccctgcaaaacggcaaagaacgcgaaaaaatgggctaccgcttctccttcgatatgttgggcgaagccgcctacacccaagccgatgccgaccgctactaccgcgactatgtcgaagccatccacgccatcggcaaagatgcggcaggacaaggcgtttacgaaggtaacggtatttccgtcaaactttccgccatccatccgcgctactcgcgcacccaacacggccgcgtgatgggcgaactgttgccgcgcctgaaagagctgttccttttgggtaaaaaatacgatatcggtatcaacatcgatgccgaagaagccaaccgtctggagctgtctttggatttgatggaggctttggtttcagaccctgacttggctggctacaaaggtatcggtttcgttgtccaagcctaccaaaaacgttgtccgttcgttatcgactacctgatcgaccttgcccgccgcaacaaccaaaaactaatgatccgcctcgtcaaaggcgcgtattgggacagcgaaatcaaatgggcgcaagtggacggcttgaacggctatccgacctacacccgcaaagtccacaccgacatctcctacctcgcctgcgcgcgcaaactgctttccgcgcaagacgcggtattcccgcaatttgccacccacaacgcctacactttgggcgcaatctaccaaatgggtaaaggcaaagattttgaacaccaatgcctgcacggtatgggcgaaaccctgtacgaccaagtcgtcggcccgcaaaacttaggccgccgcgtgcgcgtgtacgccccagtcggcacacacgaaaccctgctcgcctacttggtgcgccgcctgttggaaaacggcgcgaactcgtctttcgtcaaccaaatcgtcgatgaaaacatcagcatcgacacgctcatccgcagcccgttcgacaccatcgccgaacaaggcatccacctgcacaacgccctgccgctgccgcgcgatttgtacggcaaatgccgtctgaactcgcaaggcgtggacttgagcaacgaaaacgtattgcagcagcttcaagaacagatgaacaaagccgccgcgcaagacttccacgccgcatccatcgtcaacggcaaagcccgcgatgtcggcgaagcgcaaccgattaaaaaccctgccgaccacgacgacatcgtcggcacagtcagctttgccgatgccgcgcttgcccaagaagcggttggcgcagccgttgccgcgttccccgaatggagtgcgacacctgccgccgaacgcgccgcctgcctgcgccgttttgccgatttgctggagcagcacaccccagcactgatgatgcttgccgtgcgcgaagcaggcaaaacgctgaacaacgccattgccgaagtgcgcgaagccgtcgatttctgccgctactacgcaaacgaagccgaacataccctgcctcaagacgcaaaagccgtcggcgcgattgtcgccatcagcccgtggaacttcccgctcgccatctttaccggcgaagtcgtttccgcattggcggcaggcaacaccgtcatcgccaaacccgccgaacaaaccagcctgattgccggttatgccgtttccctcatgcacgaagccggcatcccgacttccgccctgcaactcgtcctcggcgcaggcgacgtgggtgcggcattgaccaacgatgcccgcatcggcggcgtgattttcaccggctcgaccgaagtggcgcgcctgatcaacaaagcccttgccaaacgcggcgacaatcccgtcctgattgccgaaaccggcggacaaaacgccatgattgtcgattccaccgcacttgccgagcaagtctgcgccgacgtattgaactccgccttcgacagcgcgggacaacgctgctccgccctgcgcattttgtgcgtccaagaagacgttgccgaccgtatgctcgacatgatcaaaggcgctatggacgaactcgtcgtcggcaaaccgattcagctcactaccgatgtcggccccgtcatcgatgccgaagcacagcaaaacctgttgaaccacatcaacaaaatgaaaggtgttgccaagtcctaccacgaagtcaaaaccgccgccgatgtcgattccaaaaaatccacgttcgttcgccccatcctgtttgaattgaacaacctcaacgaactgcaacgcgaagtcttcggtcccgtcctgcacgtcgtccgctaccgcgccgacgaactcgacaacgtcatcgaccaaatcaacagcaaaggctacgccctgacccacggcgtacacagccgcatcgaaggcacggtacgccacatccgcagccgcatcgaagccggcaacgtttacgtcaaccgcaacatcgtcggcgcagtcgtcggcgtacagcccttcggcggacacggtctgtccggcacaggccccaaagcaggcggttcgttctacctgcaaaaactgacccgcgccggcgaatgggttgccccgaccctgagccaaatcggacaggcggacgaagccgcactcaaacgcctcgaagcactggttcacaaactaccgttcaacgccgaagagaaaaaagccgcagcggccgctttgggacacgcccgcatccgcaccctgcgccgtgccgaaaccgtccttaccggaccgaccggcgagcgcaacagcatctcatggcacgcgcccaaacgcgtttggatacacggcggcagcacggttcaagcctttgccgcactgaccgaacttgccgcctccggcatacaggcagtggtcgaacccgacagccccttggcttcctacactgccgacttggaaggtctgctgctggtcaacggcaaacccgaaaccgccggcatcagccacgttgccgccctgtcgcctttggacagcgcgcgcaaacaggaacttgccgcccacgacggcgcactcatccgcatcctcccttcggaaaacggactcgacatcctgcaagtgtttgaagaaatctcttgcagcgtcaacaccacagccgccggcggcaacgccagcctgatggcggtcgccgactgattttgccgaaatacccgggcgcggcccgtgaaccaatgccgtctgaaaacctttcagacggcatttttataatggattaacaaaaatcaggacaaggcgacgaagccgcagacagtacagatagtacggaaccgattcacttggtgcttcagcaccttagagaatcgttctctttgagctaaggcgaggcaacgccgtactggtttttgttcatccactataacagcaaccctgtcgccgtcattcccgcaaaagcgggaatccagtccgttcagtttcggtcatttccgataaattcctgttgcttttcatttctagattcccactttcgtgggaatgacggcggaagggttttgttttttccgataaattcttgaggcattgaaattccagattcccgcctgcgcgggaatgacgattcataagtttcccgaaattccaacataaccg

SEQ ID NO: 37850 - DNA, 5532 bp, Neisseria meningitidis
tttgcggatcaacccgcccgcgtagccggtcagtttgccgtcgctgccgatgacgcggtggcagggaatcaggatagatactttgttctgcccgttggcggcggcaacggcgcggacggctttggggttgcccaaacgctgcgcctgctccttgtagctgcgcgtttcgccgtaaggaatcgccaagagcgcgtcccatgcctgcttttgaaactcggtgccaatctgctccaaaggcgtggcaaaggttttcagacgacccttgaagtataagtccaattcctgccgcaaaagttgcgtccgctcatcctcccgaaacacaaaccgtccgcgcaaggctttttggacggcggcaatttcctgttccaaatgcttctgtccgacaaattccagcaaacacaaacccctgctaccgaacaccgccagcatctcgcccaaaggcgtggcaatggcggcacacaccagctcgttcaaactgtcgggataacgcgcttccaacagacggatggcgcggcggatgcggacatattcttcaggcgcgcagccgatattgtcccaaaaatcccgctcgaactgtttggcttcgcattccgtcagattgggatgcggcataacgccgcactcaaaaacccgagattcgagccaatggcggatttcatcccattttgacggcagattgtttaaggaaggcagggtaatcatttgtttgctccgtatccctatcatagatttgacggcaaaatccccaatttttgccattcccgcacgccggagcaggaacgggctatgacgtaaatcttgagggttaggttgcggcaatacctaaatattcgatatttctaaagcatcagagaaaggaatgtttcaacacacaggacgacacataaagcgccgccccatgaaaaatttcagacgacctgcaaagggtcgtctgaaaccacgatttttgcatttgcgcattctggcacatcatccaaccgtttcggcacattcctgccgccgttgacagcctataatgaatccacttattcatcaagcaaaggaatcatctatgcaaaccctcatcctctccgccgtactgctggctttttcaaccgctgcctttgccgggggcgcattcacgctgcaattcgacaacccgtccgaagacggcggcttcacgcaaaaccagcttttgagcgcgccttacggcttttgctgttcaggcgacaatgcttcgcccgcgctgtcgtggaaaaatccgcccgccgggacaaaagtttcgtcctgaccgtttacgataaagacgcgccgaccggactgggctggatgcaccgggtggtcgccgacattcccgccgatgtccaccgccgcaacgcgacctcgctgcaattaagccgctgcgccaacatcgccgaccggactgggctggatgcactgggtggtcgccgacattcccgccgatgtccgccgccgcaacgcggcctcgctgcaattaagccgctgcgccaacatcgccgacgaccagtccgcagccatatcggcggtaatcagtttgcggatttgccgcatcaggttgacgccttcgtacacggcaaaaccgatgccgtcatgctgcaaccacgccaacacgccgcaaagcgcggcctccgcagcattgtgcggcacttcttcatccgccagtaccgcagcctcataatcaaacgccgcgcccatacgcccggaatacggcagctttaccgcatcgcacactgcctgcgccgtcccgtattgtgcggcgaacctttctacggtttcctgttcgaaagcaatccattgcgcctgatagaggccgtctgaatcgggaatattgatgacgtcaaacgtctgtccgcctgccaaggcgaccgccttacccgccgcagcttcttacttccgcgccgcacgataagcacagccggttcatataccgccacgctgcggtacaaggcggtatgatgttgcacgatgccgcctaaagcacccaatcgttcgcgcgtatgaaagtatagtggattaaatttaaatcaggacaaggcgacgaagccgcagacagtacaaatcgtacggcaaggcaaggcaacgccgtactggtttaaatttaatccactatatctcaaacccacgttaggtctaagcaaatggtcggacatccttatccgacagcccatcttcttttcagacggcattgcaaatttaagtttgacgtgcgttcaaaataaggcagttaatgcgaagcgaaattccgtcggcgtacctgcaacttggcccctcccctataggggagggtcggagggagggtaaaacggggcagatacagacaatatttccgttgccgccccgatgccctctccctaaccctctcccacgggagagggaatggattgccgttgaaataaatcgctctacataaaaaatcaatgtgttatctcaaacccacattaggtctaatcaaatggtcggatatccatattcggcaagcaagctgctttcagacggcatttccagccaacaagcgcgccaatatcccctcatacaccgcagacagcttcggaatgtcgtttagccgcacgttttcgttgatttggtggatggtcgcattggacgggcctaattcgataagttcttgcgcaatggctttgatgaagcgtccgtccgaagtgccgccggtggtggacaattcggcctcaatgccgcaggtttcggcaatggctgcgcgtgccacgtcggtcagtttgcccgcttgggtcagaaagggctgccccgaacacgaccactgcaaatcgtattgcacgccgtgtttgtccaaaatggcgtggacgcgttgtttcagccctgcttcggtggactcggtggagaagcggaaattgaatttgacgttcagctcgcccggaatgacgttggtcgcgcctgtgccgccgttgatattggaaatttgaaagctggttggcgggaaatattcgttgccttcatcccagacttcctgcgtcagctctaacaaggccggggcaaaagtatgcacgggattgattgccaaatgcggataggcaatatggccttgcttgcctttgacggtcaggttgcccgacagcgagccgcgccgaccgtttttaatcatatcgcccaatttgtccacggcggtcggttcgccgacgatgcagtagtcgataagctcgtcgcgcgctttcaatacatcgacgactttggtcgtgccgtccaacgcgtcgccctcttcgtcggaagtaatcagaagcgcaatgctgccttggtggttgggatgtttggcaacgaagcgttcgcaggcggtaacgaaacaggcaatgctggttttcatgtctgccgcgccgcgcccgtataatcttccgtcgcgctcggccggttcgaacgggggcgaatcccatttttcgacaggacctgtcggtacaacgtcggtatgccctgcaaaacagacgacgggagctttcgtgccgcgtcgcaaccagatgtttttggtgtcgccgaaatggagttcttcagccgcaaaaccgattttgtgcaggcgttcggcaaggagtttttggcaatccctgtcgtcaggggtaacggatggtcgggaaatcagctctttggcaagctctagggattgagtttcggtcatatttgttcacttttgaaattagaccgtctgaaacgttctgaatgtgattttcagacggcatttaggttaggttggcatacggggtgggtattttacccatcagtcttctgaatcatttgccgtggcaggcttcgtaaagcggcagcaaatcttccaccgtttccgctatccatttcgcgacatcctgcctgcccaaatcgtcgcgttcgatgtgtttgccgatgcagaaaaagtcttcgtcgttttgcaactttcggtcggactcgttttgttgcgcgacggtgcggtagtcgtcgtattcgctttccgcaccgtgccacatatcgaaagaagcgtatttttcggtatcaaaattatccaaccagcggttgtaatcaggcagcgcgatgggggaaacatcggctttatagcagtgccaatccaagctgacgctcagacggcggcggttgagcagtatcgacaaaatcgctgcggaatttttatattgttcgtatttgaagtaggcaaagaaatgggcgcgaacctgccagccgttacaccagcgttcgatgtgcggcggcgcaaacggcgcacccaattcggcggcaacctgctgaatcagctgctgccatatctgccagttttctttatagtcagccttgatttgcggaatgctttcaggctggtattttttaagctgggaaaattggaaaaacgggatattgaacaaatcgcaacttttcggggtcagcataatatatccttgagacgattgtttcagacggcattatttgcgccggcgcgccgccataatttcgccgatttcggtcagtttttcttttgggataaaggtgttgcccatatcaaacagcggctcttcaatcgccaaatgaacatcatatcccgccacaaaacgtttgaacgcttcctcatcggggacataagcgttgtctgcttcgagtttggcaaattcggcggaaacagccgcccagttgtcgtgcagcccgatatgttggcgcaaaagctcgtccacgctttcttgggcttgcggcgcatattgcagcagcagcgggaagaagttttcttcttcgtcttcatggtgcagcggcgcggcaacgttgaaatactgggcgatttggcggatggtttgcaaaacaatctgattgcagccgttttcggcgatatagtccgacagcatggcgacttgtccgcaaaaacggcgcactttgccgtggcaggcatacagcatttcaatcggttcggcaaaggtaacgcttttggtttcaaacggattcatgttttcgttctcaacgggcacttttcaagcagtcattttataataaaacagcctgcacaaagcaggctgtccgtcttttgagactttaagcggattaatcgaccaaagtcactttgccgttcatcaaagcaccgtgacctgggaaggtacaagcgaatttatattcgccgtcggccaatttagcaggatccagagtcagggaagcttcttcgccgccgccgatcagtttggtatgggcaacaacgcgtgcatcatcaggtttgacatagtcggtatcggcagcacctacgccgtctttaaatacgccgtccatgtcttcagctttggcaatcacgagattgtgacccatgctggctttgggttgcgtaccggtatgtttcagagtgatggtgaactctttacatgctttgctgacttggatgtctttggtgttgaactgcatattgtcgttggattcgacagttgccgcacagttgccggcagcaggggcttcggcagcatctgcaggagcagcttcggcggcaggcgcttcggaagcgggtgcttcagcagcaggagttgcctcggcagcaggcgcggcaggttcttgagagcaggcagccaaaccgataacggcggcagg

SEQ ID NO: 37851 - DNA, 1699 bp, Neisseria meningitidis
ccgcaatattcgtgaaacgtcggtcggcatcgatgatgtgaaaaaacccccgcttttgctgggtttgtttttttgggtggttttctggcacggctatcgtcagaatcggggtgcaggttcggattcggattcagattcagattcagattcagattcagattcaggtttgtgtcccattgccgcgctttatagtggattaacaaaaatcaggacaaggcgacgaagccgcagacagtacaaatagtacggaaccgattcacttggtgcttcagcaccttagagaatcgttctctttgagctaaggtgaggcaacgctgtactggtttaaatttaatccactatatcggttgaaactctgattttaaggcggtaggatgtgggtttgcccatagaaagggaatcctttctgtatcaagccctgaaagggataattcatacaaattcacgcctttccccctcattgggaaatggatggaatcgtgccagatgtgtgcggcactgtatgccggatatggttttatcatcagcccttttcggttgaaaccccgtcagttgcagcgattgagcctaatcggtggcggaagttgccgctttgcattcggggcggcgtgcagtgcggtgctttgatatgccgtttgtgtgttgaaacagggtggtcggtgcatacgggtacggtatggccaaagctaaaagtgaaatacgctgaaacactgaatgagccgctttattgtttgtacggcctttgctgccttgctatgatttaaattggattcgcccgccggatattttgggatatgaaagaatttgacttcatcaaacggtatttgcaaacaggcacggataatgatgtcgtattgggcataggcgacgatgcggcgattgtccgcccgcgtgaaggcttcgatttgtgtttcagtgcggatatgcttttgaaggacaggcatttttttgcagatgtcaaacctgaagacttggcttggaaggttttggccgtcaatatttcagatatggcggcgatgggtgcgataccgcgttgggtgttgctgagcgcggctttgcccgaattggatgaggtatggctgaaacggttttgcggcagctttttcggtttggcaaaaaagtttggcgtaacgttaatcggcggcgatacgaccaagggcgatatggcgttcaatgtaaccattatcggcgaattgccgaagggtagggcgttgcggcgtgatgcggcggttgcgggcgacgatatttgggtgtcggggcgtatcggtatggcggcggcggctttgaactgccgtctgaaacggtgtgtgttgccagatgaagtgtttgccgaatgcgaacaaaagctgctccatcctgaaccaagggttgggctggggcttgcgctgttgccgtttgccagggcggcgcaggatgtttcagacggcctcgcgcaagatttggggcatatcctgaccgcttctggcaagggtgcggaaatttgggccgattcgctgccgtctttatccgtattgaaagatattttgccccgagcgcaatggctgtcttatactttggcgggcggcgacgattacgagctggtgtttaccgcgccggaaagttgccgcagccgcgtatttgatgcggcggaacggtgcggcgtgccggtaacgcgcatcggcaaaatcaacggaggatgccgtctgaaggttttagatgc

SEQ ID NO: 37852 - DNA, 782 bp, Neisseria meningitidis
cctagtttctacagcggcctgtatgttggcaattcagcagcttcttctgtatctgctgtacaaatttaatgagggaataaaatgaccaaacagctgaaattaagcgcattattcgttgcattgctcgcttccggcactgctgttgcgggcgaggcgtccgttcagggttacaccgtaagcggccagtcgaacgaaatcgtacgcaacaactatggcgaatgctggaaaaacgcctactttgataaagcaagccaaggtcgcgtagaatgcggcgatgcggttgctgcccccgaacccgagccagaacccgaacccgcacccgcgcctgtcgtcgttgtggagcaggctccgcaatatgttgatgaaaccatttccctgtctgccaaaaccctgttcggtttcgataaggattcattgcgcgccgaagctcaagacaacctgaaagtattggcgcaacgcctgagtcgaaccaatgtccaatctgtccgcgtcgaaggccataccgactttatgggttctgacaaatacaatcaggccctgtcagaacgccgcgcatacgtagtggcaaacaacctggtcagcaacggcgtacctgtttctagaatttctgctgtcggcttgggcgaatctcaagcgcaaatgactcaagtttgtgaagccgaagttgccaaactgggtgcgaaagtctctaaagccaaaaaacgtgaggctctgattgcatgtatcgaacctgaccgccgtgtggatgtgaaaatccgcagcatcgtaacccgtcaggttgt

SEQ ID NO: 37853 - DNA, 4583 bp, Neisseria meningitidis
gccgatttggacgcgctcgagcataatgttgcccacaattttgccgaatatcaggaagctgcccacatcstttctgccatgcgccatcaggcggcagagcgtttgagcggcgaaacgaccgagcatatgcaacaccttgccatgaaaggcgcgcgtttcgacatcgtcctgttgccttcgtcgccgacggcacacggtttggagcaggttcaatttcaagttgccgccaacaaaggcaatccgccccgtctgctgaataaagttgcctccggcggcgaattggcgcgtatcagccttgccttacaggttgttgccagccaatatacccaagttcccaccctgatttttgatgaggtcgataccggtattggagggggagtggctgaaatggtcggcaaggcattacgtgcgttgggcagaaaacatcaggtgcttgccgttacccaccttccccaagtcgcatcctgcggagaaaaccactggcgggtgcgcaagcacagcgagggagagcaaaccgtcagcgaaatcagtatattggatgaaatccaacggatcgaagaggttgcccgtatgttgggcggagaagtcattaccgatacgacgcggcaacatgcggcagaattgctgcaacttgcgtcgaaaaatagtttattttaaaatcaatcagttaaaaaataactaaaaataaaagtctaaaacaatagacagaactcagataaatccgtattatcacgctttcttaatcacttgaacaagtgattgtgctgcacccgtagctcagttggatagagtatctggctacgaaccagagggtcgggcgttcgaatcgctccgggtgcgccagtaagaaaatacaatatgcgcccatcgtctagcggttaggacatcgccctttcacggcggtaaccggggttcgattccccgtgggcgtgccaattcaaaatgcctccgattatatcggaggcatttctcatttctcatttctcatttctcatactgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcggattaacaaaaatcaggacaaggcgatgaagccgcagacagtacaaatagtacggaaccgattcacttggtgcttcagcaccttagagaatcgttctctttgagctaaggcgaggcaacgccgtactggtttttgttaatccactatattgagtcctcgagaagggaaataaaaattaacatccttatatattgagttcctgagaagggaagattaacaaaaattaacgccctttacttcatacaatcaacagggctttttcattccttccttatctaacagggggtacagaaaccgaaacggctggcagggttaaggaagtcttcgaatgttacggaacattcatcttggacagcaaaggcaatttgttaggcattccttactccttattttgggaagaaaacgttatgggtgttttcgatattttaccgtcaggattggtatgtttatttgaatatgattttctgtggtcgggacggcatgcggcaaagacttaaggggttagatccttccttctgacgatggcgcggatgatggtgcggttggggtgtagggcgtggcgcaggcgttgtgaaaagggatggggcaagcctaggatttgggctgcaatggcggcggcgcagatgggggcggtggcgagtccgcgggtgccgtgcgcggtgttgacgtaggcattaggcaggtatgggcatggggtgtcgatgcggtagtttttgtccagcgcgagtttggtgtaggtctgccgcatggcggcaatgtcgccgagtgcgccgactaggggaaggtggtcggggctgtcgcagcgtatggcggcgtgcccttggtgtttttgggggtttgggttggcggcaaacaatgattcggaaagggcggggttaaggtgtgccaatgcttggcggtttgaggcttcttcggcttcgttccatccggtatggctgctgttgggaataaaactcgcgccgtagcagtgcagtccgtgccacgacgggctgatgtagctttcgcctgaaacggcgcaacgcagttgttcggaaaacggggtggacggtgtgaggccggtttgtccgcgtatttgcctgagaggcagggcggcgaggttggtttcgggtaggtaggggctgttcgcaccggtgcagtagatgatgtgtgtggcggtaaatgtgccgtttggcgtgcttgcaatccacttttccccgtcgtgggaaatgtcggtcaagggtgtgtcttcgtgtagtccaatgagcggatggttgaggagggtgcggacgaatgcgggtggattgagccatacgccgtgttgccagtagagtccgcatgaagggtggtcgtatgggacggacagtgggataccggcgattttttcggcttctgcagatgtgatgctgcggtagaggtggttatggtgtttttgcaaacccaattcgtgattgcgttgttgttcggtgcggctgtaattgaggtggatgatgccgttgccgccccaggtttcggattcgggcaggatgtgtccgagcaggcgtttggtgtagccgtagccggcaagcaaaagttcggtctgttcggtgtcgtgcggcgagattttggcgtagagcagcccttggcggttgccgctggcggcttgggcggcttttcgggcttccaatacggtaacggaaatgccgtgtgatgctaaggcgtgggcggttgccgcgccggatatgcccgcgccgataacgaggatgtgttccggtttttgccgttcggatgtttgtggaagtgcaaaccagggtttgtcgggcttgctttcggtttgcgggatggcttcggtctgccaggaaatgtggtggaaatgttcgtgcaggtggtgggtgcgtgaagggggaaccagccagaagcggacatcgggcaggatgtgttcgatgaggttgatgctgtcgaactggaggcactgcattgcctgatccaaacggtgcttcagacggcattccgcgtccgaagcatcttgtgcggtttgaaaatcgggaatctgattatcggggaggcagataatcaggttgagcgggggtgcgtgtttgcggatggcttggtcgagtgtgcggatgtcgggaatgccgtcccatacgagattgtccatatcaatgccgtttaaagtgtgggtttgaatatcggtatcgggataaagctgttaaaatacgcgccgtttgaaggcacgcctgcgcctgccggatattgtatgccgaaccgaggtgttttttgaataatattcctgttgaaatccgtttgttgaaaaaccgtaccgtgttggttttgacttatggggacgaacctaaaaatctgcctgccgaatttttacgcgtctattcgccgagtgcggaagtgcgcggacacggcgtgggacaggatgttttgcagaccggcaaggcggatgtccaaatcgcggatttgcagcctgtcggacagtacgcgctgaaaatcagtttttcagacgggcacgacagcggtctttacgattgggcgtatctgcacagactggcatacggatacgatgcgatgtggcaggaatatttggacaaattggcggcggcgggcgcgtcgcgttttgaagagaaataagaccggtcggatggtaatctgacgggcaaaggtatcagagaggtggttagaatatgggcggacagaaaacgcatttcggattcagtacggtcaacgaagatgaaaaagccggcaaagtggcggaagtgttccactccgtcgccaaaaactacgacattatgaacgatgtgatgtcggcagggctgcacagggtgtggaagcatttcaccatcaacacggcgcacctgaaaaaaggcgataaagtgttggacattgcgggcggtacgggcgatttgtcgcgcggttgggcgaaacgggtcggcaaggaaggcgaggtttggctgaccgatattaattcctctatgctgaccgtcgggcgcgaccgtctgttgaacgaaggcatgattttgcccgtatcgcttgccgatgcggaaaaactgcctttccccgacaattatttcaacttggtttccgtggcgttcggcttgcggaacatgacgcataaagatgccgcgctgaaagagatgtaccgtgttttgaaaccgggcggcacgttgctggtgttggagttttccaaaatctacaaacctttggaaggcgcgtatgatttctattcgttcaagctgctgccggtcatgggcaggctgattgcgaaagatgcggagagttaccagtatcttgccgaatccatccgtatgcaccccgatcaggaaactttgaaacagatgatgctggatgcgggcttcgacagcgtggattatcacaatatgagtgcgggcatcgtcgcgctgcataagggcgtgaaattttaaacggactggctgtgcagccg

SEQ ID NO: 37854 - DNA, 1013 bp, Neisseria meningitidis
gtagaattgctaaggaatcctcacgatgcttctaacactttctttgcgtgattttgtcattgttgaaaatctgaatctggattttcaaagcggctttaccgtattgaccggagaaactggcgcgggcaagtccattactttggatgcgattggtctgctgttgggcgataaagccgattacagccaagtccgcagcggcgcaaaagaagcgcagttgtcggcgttgtttgatatttcccatttacctgttttaaaagcagaattgtatgaacaggggcttttaaacgacggagaagaagaactcagtatccgccgcattatcgatgccaaaggcaaaagccgcagctttatcaacaatcaggccgctaccttggcgcaactcaaagccgtcggtagccagcttatcgacatccacgggcaaaacgcccatcattcgcttaatcaggaagccgcccagcgcgaattgttggacgcatttgcgggtagcagggagcaggcggaaaccgtcaggcagctttatcaaaattgggccaatgcgaaaaaagccctccaagaggcgcaggaacacgccgatgccgtcattatcgagcgggagcgtctggaatggcagtttaacgaattgaatcagttggacattaaacaaggcgagtgggaagccctcagccaaagccacgacagccttgcccattctgccgagctgttgcaggctgccgaagaagtcggaagcaagattgacggcgacaacggcatccaacgccatatctatcaatgtcaaaaactattggccaatctgcaaaacatcgagccgcgctttgccgagagcctgaatatgttggcaagcatcgaagccgaattgggcgaaatcagtgccaatatgcgcgatgtggcaggtcgcagcgacatcaatcccaacgaacttgccgcacaagagcagcgcatgggcgagctgatggggatggcgcggaaataccggatcgagcctgaagagttgcctgccaagttggcagaaatcg

SEQ ID NO: 37855 - DNA, 463 bp, Neisseria meningitidis
tcgactctagaggatccccgggcgtattcggcgcgtggcttgccacacccagcaccattcggcttcaaagccaaaaaatcaacacaccgtcaaaaatgccgtccgaacccgttttcagacggcatttcaatttgcctagtataatggcgcatttttccaacaaggaacctaccatgctgacctcggaacaagtaaaagccatgattgaaggcgtggcaaaatgcgaacatatcgaagtagaaggcgacggacaccattttttcgccgtcatcgtttcatcagaatttgaaggcaaggcacgcctcgcgcgccaccgcctgattaaagacggactcaaagcccaactggaaagtaacgaactgcacgcactttccatttcggttgccgccactccggcggaatgggcagccaaagcacaataatcgccacacaaaaatgccgtctgaaaccatttcgtttcaga

SEQ ID NO: 37856 - DNA, 137 bp, Neisseria meningitidis
ttgcatgcctgcaggtcgactctagaggatccccggcggatttttgccgcgtgttccgcgtcggcgtgtgcgtttaaggcttcgagggcgtttgcggcggctttgaggcggctgcgtgtttccgcccagaccgtcca

SEQ ID NO: 37857 - DNA, 384 bp, Neisseria meningitidis
ccgggaccttttttctccagaaagccggcaatggggctgtcgggccgggtgggcatcagcagctcgatcaaggtgtcgcccaccacgaaggcgcggacccgcacaccctgagttcccacgtcttcgtcggggccttcggggcgcaggccgagcgcgacataaggtgcggcgccctgatccagatcgggggtggcgatggcgacgtggtcgaggagcatggcctcagcttatacctgctgaccaggacgcggcacacaaaaatgaaccgggaacaggttttttctggacgccggccccgctcgttacactctgaagtgtgaccctgaccgccctgctcgccctgctgctctcgtacctcatcggcgctattccggcggcggcgtg

SEQ ID NO: 37858 - DNA, 2132 bp, Neisseria meningitidis
cttcgtcaacgaaagcgcgcaaaacatccgccgcatccttgccgaagtgccgatacacatcatccaattccacggcgacgaagacgacgcattctgccgccagttccaccgcccctatatcaaagccattcgtgttcagacggcatcagacatccgaaacgccgccacgcgcttccccgacgctcaggcactgctgttcgatgcctaccatccttcggaatacggcggcaccggaaaccgcttcgactggacgctgctggcggaatattcgggcaaaccgtgggtgcttgccggcgggctgacccctgaaaacgtcggcgaagccgtccgcatcaccggagcggaatcggtcgatgtatccggcggtgtggaagcgtctaaaggcaaaaaagatgccgccaaagtcgccgcctttatcgcaaccgccaaccgcctatcccgttaaagcaacaaaaattgccgccggaatgacttatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactataatctaaaaaatttatgctattaaatcagtaatttctgatgaattttgaaaacttaatcccgtcattcccgcgcaagcgggaatccggctcgttcggtttcgcttgttttaagtttcgggtaacttccacttcgtcattcccgcgcaggcgggaatccggttcattgaatttcagctatttagaataaattttgaaactctaatcgcgtcattcccacgaaagtgggaatccaggacgcaaaatctcaagaaaccgttttacctgataagtttccgcactgacagacctagattcccgcctgcgcgggaatgacgaatccatccatacggaaacctgcatcccgtcattcccacgaaagtgggaatccggttcgttcggtttcgcttgttttaagtttcgggtaacttccacttcgtcattcccacgaaagtgggaatccagttttttgagtttcagtcatttccgataaattgccttagcattgaatgtctagattcccgcctacgcgggaatgacggattttaggttgggggcatttattggaaaaagcagaaaaccaaaaacagcaacctgaaattcgtcattcccgcgcaggcgggaatccaatgcgttgagtttcagctatttagaataaattttgaaactctaatcgcgtcattcccacgaaagtgggaatctagaaatttaatgttgcggcactagccaaaaaaaccgaaaccgaacggactagattcccgcctgcgcgggaatgacggctgcagatgcccgacggtctttatagtggattgagacctttgcaataacataggttactaaaattttatgctcaatctcattttcaaaatgcaaaacttttctgatttttcctactttttgctcaatattaggaaggttttaggcaattgaaaattttttggcgcatttttatgcgtcaaatttcgttaacagactatttttgcaaaggtctcggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactataatatgcacagataatatcaacccgtttttaacaaagatattcccggcatttgcgtaaagttcagcaagaaaaactacaaacccagtcgcgcaggaagcggatgtcgtccgcccaaccggatttgactttgacccagaccttcaaaaatactttggtatcaaacagtttttccatatccaaccgcgcttcggtggaaattttcttcaaacgttctccgcctttaccgattaaaattgccttttggctttccttatcgaccaaaacggcgatatagatgcggttcaaaccgtcttcctcttcaaactgctccacttcgacgttcatcgcataaggcaattcctcgcccaagtagcggaacaatttttcacgcacgatttcgcgcgctgg

SEQ ID NO: 37859 - DNA, 3739 bp, Neisseria meningitidis
  misc_feature (3735)..(3735): N is any nucleotide
ttttcagcttggtcttaacccgcccctgcttgagttgggaaaggctttcgacaaacacgatgcccatcaggtggtccaactcgtgctgcacgcaaatcgccaacaagccgtccgcctccagcgtgaacttttcgcctttttcgttcaaagcctcgacggttgcataatctacatttgcacgtaaagtatgcagtggcacgcgaccttcacgataccattcgctacgggcaatatccgcaccattcagacggcctgaagtcataatcttaatgcctttagcaccagaacgcattgcattttgcattgctcgtttcatagcacgacggaattgaacgcgcttttccaactgctgggcaataccgtcagcaataatttgagcatccaactcaggacggcgaatctcttcaatatttacatgaacaggtacacccatcaagacttgcaagtcacgtttcaaaacctcgatatcctcaccttttttaccgataaccacacccggacgagcggagtgaatggtaatgcgtgcagattttgcagggcgttcaataaccactcgaccaaccgaagcattggccaatttttgacgcaaataattgcgaacatcgatatcctgcttcaaaacagtagaaaagtcggtgcttttagcaaaccattttgaagcccagtctttagttaccgccaggcgaaagcctgtagggttaatcttttgtcccatagcttttccttagttacccactgtcacattgatatgacaagtttgtttttcgatgcggttaccgcgacctttggcgcgagcttgaaaacgtttcaagcttgggcctttgtcaacaaagatagttaccactttcagttcatcaatgtccgcaccgttattgtgctcggcattagcaatagctgactccaatacttttttaatcagctcggcaccttttttaggactgaaagccaaaatattcaaagcttgggcaacgtctttaccacgaatcaaatcagctaccaaacgagccttttgagcagagatacgggcatttttatgttgtgcatttactctcatgattcaccttatttctttttagcctttttatcggccaagtggcctttaaaggtacgggtcaatgagaattcgcctaatttatgaccaaccatattgtcgctgataaacacaggcacatgggtgcggccgttgtgcacagcaatggtcagaccgataaaatcaggcagaatggtagaacgacgagaccaggttttaatcgggcgtttgtcgttgcttgcgcgagcagcatctacttttttcagcaaatgcaggtctacatatgggccttttttcaatgaacgagccatactaaattaacctttatttgagtaacggcgacgaacaatcatgttatccgtgcgtttgttattacgagtgcggtagcctttagcaggagtaccccatgggctgaccggttcgcgggcctcgcccgtacggccttcaccaccaccatgcgggtgatcgacagggttcatgacaacaccacgtacagtcggacgaataccgcgccaacgattggcaccggctttaccgatttttttcaggctttgctcttcgttaccgacttcaccgatggttgcacggcaatctacgttgattttacggacttcgccagagcgcaggcggacttgagcgtacgcgccttctttagccagcaataccgcagaagcaccggcagaacgtgcaatttgcgcacctttacctggtttcatttcgatacagtgaatagttgtaccaacaggaatattgcggatcggcagagtgttacctactttgatcgcagcttcagcaccggaaaccaatactgcaccggcttgaataccacgaggagcaataatgtagcgacgctcaccatctgcatagcacaacagtgcgataaatgcagtacggttagggtcatattcgatacgctctacttttgcagggataccgtctttgttacgtttaaaatctacgacgcggtaatgatgtttatgaccaccacctttatgacgggtagtaatatgaccattgttgttacgaccggcagtagaatttttcttttccagcagaggtgcataaggtgcacctttgtacaaaccttctgttaccacgcgaaccatgccgcgacggcctgcagaggtcggcttcattttaacgattgccattttgtttattccttatctgcagctgcagcagcggcttccaaatccaactcttgaccggcagccaagcttacataagcctttttaacatcgctgcgacgacctaaagtgcgaccaaaacgtttaactttacctttaatggtaacagtagtaacgtctgcaacttgaacgccgaacagcagctcaacagccgctttaatttcaggtttggttgcatttgccaaaactttaaacgtcatttggttacgtttttcagccaatacgttgcttttttcagaaacgataggtgccaaaatcacttgagtcaaacgttgttgattcatacccattgctcctctaattgtgcaactgcatctttagtgatgattacttttttgtaacgcagcaagctgtaaggatcaacttgttgagcttccaaaaccaacacgtttggcaagttgcgtgaagccaagtaaacattctcgtcgagctgtttggttacaaacaacacttgctccagacccagatttttcacttgttcggcaaaaactttggttttaggagtttcggcagtcaacgcctcaatcgcaaacaaacgctcgtcacgagtcaattgggacagaatagtcgccataccggcacggtacattttgcggtttactttttgagtgaagttttcgtcgggtttgttcgggaacgcgcgaccacctttacgccacagcggagaagaagtcataccggaacgggcacggccggtacctttttgacgccatggttttttggttgagtgttttacttcggcacgggttttttgagcgcggttaccggagcgggcgtttgccaagtaggcatttaccagctgatgaaccaacgcttcattgtattcgcgggcgaacaaagcatcagaaacagacagactgcctgaaacttgtcctttagcgtcaattactttcaattccattacgcacctactttcacgctgggacgaactacaacatcgctgttgaccgcacccggaacagcacccttaaccaacagcagttggcgttctgcgtcaacacggacaacttccaatttttgaacagttgctttggtgttgccgtattggccggccatgcgtttaccggggaacacgcgacccgggtcttgcgccataccgatagagcctggaacacggtgagaacgggagttaccgtgggaagtacgttgggcaccgaagttatgacgtttaatcgtgccggagaaacctttacctttagaggtaccggttacatcgaccagttgaccgacttcaaacatagaaacggtgatttcgtcaccagctttcaattcagccagtttttcttcagtcaaagcaaactcaatcaaaccgcgaccggcttcaacacctgcttttgcaaagtgcccggcttcggctttgttgacacgattggcttttttctgaccaaaggtaacttgaacggcagtatagccgtcagtatctttggattttacttgtgtaacgcggttggcagacatatccaaaacggttaccggaacagaaacaccctgttcgtcgaacacgcggggtcattaccnaact

SEQ ID NO: 37860 - DNA, 2456 bp, Neisseria meningitidis
ggttttaacctgcaaaacatcgtccgcattctgcggattctgccaaacggcgagatagccgtaagtatcggcagcccgtgccgccgcagtcatcaggcatagtgccgatacggccagtatctttttcatcatgataaattcccgacggttcgtccaaattctgttgcattataaacaaaaaacaggataagtcccgccttatcggcttatccctccccgcagattgcaccgccgggtatggcaaaccgatttcagcagcgcaaatccgcataccgccgccttagcggcaagccgttgttttcagacggcattgcggccaacctttgcggcgggcgaaaaaccttgtcctataatttatcccgtttcaaaatcagcatacggtcggaaatgcaaaaaatatctttcaatttgttgaagcctgcaaactccccgaaaatagggaaacgccgccccggtttgaacggcgcgccgcatattccgatgccctccccccgataccttccggcaagcccagaaatgcccggcaacaacatccatccggcaaaaatccgaaacaacacacccggcggcaggcagagtcaaaccgccccgcaaagcatccgccatcagaaaaacaaaccgcctccgagggcttcatcctaaagggcgtattgttcgataatggtttgggttataatcccctatcgattctccacgtccgtgagacacttcagctatggaaaccccgaccaacaccccgcaacgctccctgcgtcaaaacagtatctacctgctgcccaattcctttactatcgccgcgctgttttccgcgttttacgcaatcacccaatccatgcacggacgttatgaaaccgccgccatcgcggtattcatctctatgttgctggacggtatggacgggcgcgtggcgcggctgaccaacagccaaagcgcgttcggggagcagctcgacagccttgccgatatggtcagcttcggcgttgctcccgctctgattgcctacaaatggcagctttggcagttcggcaaaatcggttattccgtcgccttcatctactgcgcctgcgccgccctgcgcctcgccctgttcaacacactcatcggcaaggtggacaaacgctggtttatcggcgtgcccagtccgactgccgccgcgctgattgtcgggctgatttgggtcaaccacagcgtcgaaaaattccccgccgtccactggtgggcattgggcatcacactgtttgccggcctgtcgatgattgtccaaatccctttttggagttttaaagaaatcaacatccgcagacaagtcccctttgtcggaatgctgcttgccgtcttactgctgcttctggtcacttgggaaccgtcgctcgtcctcttcctgttctttctcggatacagcctgtccggctacattatggcggcacgccgattttggaaaaagtacagaaaggcggattaaatgtggcattgggacattatcttaatcctgcttgccgtaggcagtgcggcaggttttattgccggcctgttcggcgtaggcggcggcacgctgattgtccctgtcgttttatgggtgcttgatttgcagggtttggcacaacatccttacgcgcaacacctcgccgtcggcacatccttcgccgtcatggtcttcaccgccttttccagtatgctggggcagcacaaaaaacaggcggtcgactggaaaaccgtatttacgatgatgccgggtatgatattcggcgtattcacgggcgcactctccgcaaaatatatccccgcgttcgggcttcaaattttcttcatcctgtttttaaccgccgtcgcattcaaaacactgcataccgaccctcagacggcatcccgcccgctgcccggactgcccggactgactgcggtttccacactgttcggcacaatgtcgagctgggtcggcataggcggcggttcactttccgtccccttcttaatccactgcggcttccccgcccataaagccatcggcacatcatccggccttgcctggccgattgcactctccggcgcaatatcgtatctgctcaacggcctgaatattgcaggattgcccgaagggtcactgggcttcctttacctgcccgccgtcgccgtcctcagcgcggcaaccattgcctttgccccgctcggtgtcaaaaccgcccacaaactttcttctgccaaactcaaaaaatcttcggcattatgttgcttttgattgccggaaaaatgctgtacaacctgctttaaaacacacgaaaaaacctttttaccgtttgcacaagcaattaatcaggacaaagctgcccagtctcctgttccgacaaaaggacagacaacctgaccgagacctttgcagaatatacgaaaaacgacagataccgtctgaaaccacattccgacaatcggcagggtttcagacggcatctgataatttc

SEQ ID NO: 37861 - DNA, 996 bp, Neisseria meningitidis
ccttattgtgggaagtatgcggcgaagaggaatttaccgccgaagccatcgccgaagaatattacggccatgcgccgaccaaaaccgagctggcggcaactttgattgcgctttacgccgcgccgatgtatttctacaaaaaagccaaaggcgtgttcaaagccgcgcccgaagaaactttaaaacaagcacttgccgccatcgaacgcaaaaaacagcaagacgcgcaaatcgacgcttgggcagaagcctaaggcgtggactccgccaccactcaaaatcagctctgtaaaaccggtctgagtcttcttttcccccgtactcaataatttatccgccgcctctttaccaccaaattcatttacaatttgtaaaaatcgtgtcgccttgtaaggttgcggcaaattcaaagcctcctgataaatatttaacatggctttatgaaattcttgttctaactgatttttatccatcattcttcttccaatatttcagaccggattattcttacccagaatttcttttctcatccgctcccgtctgatcacctaccgaatcaggtcgtctgaaacagtctgaaatcgcttttcagacgaccctcagcctttttcatacccttcgtaataatacgactgctcgatacctttaaagatgatttcacggttgtccacatcgtcagtcaggttgtcctttaacagaaagcgcagttctaaatcgttgacggggctgcgttccatcgcctgcaaatacagggttttacttacattttgccagttcacgacttttttcaggttttttttcagcaccaaatccagccagatgcgggtacttctgccattaccctccaaaaacggatgggcaatgttcatttcaacatatttggcgatgatttcttcaaaagtccgctcgggcatctgctcgattttaaccaaagcctcttttaaatacatggcgttggcaaaacgaaaaccgcctttggaaatgttgtcttccctg

SEQ ID NO: 37862 - DNA, 12438 bp, Neisseria meningitidis
cttggtgttgataccattcgattccattcgatgataattccattcgattctatgcgatgattccattcctttccattagaagcgcgacacggcgaaggcgatattttggtattcctgccgggcgagcgcgaaatccgcgaaactgccgaagccctgcgcaaatccacgctgcgccgcaacgacgaaatcctgcccctgttcgcacgcctgtcgcacgccgagcagcacaaaatcttccacccctcaggcgcgaaacgccgcatcgtattggcaaccaacgtcgccgaaacctcgcttaccgtgccgggcatcaaatacgtcatcgacaccggcctcgcgcgtgttaaacgctattccgcacgggcgaaagtggagcagcttcatatcgaaaaaatctcccaagccgccgcccgccaacgatccggccgctgcggacgcgtctccgcaggcgtgtgtatccgactgttttcagaagaagattttaacagccgccccgaatttaccgaccccgaaatcgtccgcagcaacctcgccgccgtcatcctgcgcatggcagcattgaaactcggcgatgtggcggcattcccgtttttagaaatgcccgattcacggtatatcaatgacggttttcaggtgttgttggagttgggggcggtggaggccgtctgaaaacaggcagacataaaagaaaatccgcgtagagtgatgtaaacttacccttgctttaataagtagaaaatggtgggtttacgtccccccctgcggctactaaaaaaatataagagtaaacaacctttttgaaagaaaaatgtatggacgaaattcaaatacccaaaaaagtggaattacaaaccaaactagaaaatgaaaagattgttttatcgaaaggttctaccacgattattgttggtgctaatggcacagggaaaacaagattagctgtttatattgaagaacaattaaaggaaaaagcacacagaatttcggctcatagagcattaaaattaaaccctaatgtcaataaaataccagaaaagagtgccaaaacatatctatcttatggtcagaactgggatggaatcgatgtatcaaatagaaaaaattatagatgggataataactcatatactcatttactcaacgattttgattggttattacaatatttattcgctcaacaaaataatattgcggtagcaaataatcaaaagctcaaccgtaatgaaaaagtaaccaattcaaaaacaaagctagatattttgcaagaagcatgggaaacattattaccacacagaaaattacatattacagcagatgatattcaagtctctgctgtagataatgaggaattgtattctgcctcaaatatgagtgatggagagcgagcacttttctatattcttggacaagttttgtcagtagatgacggttctgtcttaatttttgatgagcctgaattacatattcataaatcaattatttcaaatctatgggataaaattgaagaattacgacctgattgttcatttctaatcattacacacgatattgaatttgctgcaactcgagtagctaaaaaatatgttatcagaaattattatccgacccctgcttgggatatttctgaagttcctgaaagtaattttgatgaagaaacaataacgatgattttaggtagccgtaagccaatattatttgttgagggcaacaataatagtttagatattgctacttaccgctattgttatcctgattggaccatcatacccaaaggggcatgcaaagatgtcattcaatcagtatcatcgctgaaaaaattaagtaatgaaatgccattactaaacttaaaatgttcaggtattgtcgatttagatagtagggatgaaagagaaattgaacaattaaataatttgggtatttacattttacctgtatccgaaattgaaaatctttttagcttaactgatgtagcaaaagagatattgaaactaaatcaatattcagatgaagaattactcaataaacttaatggatttaaatccgaactaattaaatatatagataatgaattaaaagacgataaattagacgaatttgttgtaaaacaggttcgacgtaaaattgataattatttaaaaaatattgatttatcctccaaaataacaagtactgatatgaaaaaatcattacttaatgaaatttctactttaacagaacagaaaattgaaacatggatttcagaaattaaaaatgaaattcaaagatgtattgaacagcaagatttggataaattacttactatatatgataataaaggactcttggctaaatcagcttgtgttttaaaaggaatgcgtaacaaacatgaatttgaaagctggataatgagaacattaaaaggaaggaataaagattttattgatgcaatcagacagaaacttccaattctggattaaataaaaccatctgaaaatttaccttcagatacagatatatttcatgaaaaatcatcaaactacactctctttccctacttcgagtagcctgaaaccttgcgcagacaaacaaggcctgtctgaagaccgcagccaataccgcctgaccaaactcggcgaacaaatggcgcacctgcctatcgacccgaaaattgcgcgtattttgttagtattattccgtttttaaaaatgcccgattcgcggtatatcaatgacggttttcaggtattgctggaattgggggcggtggaggccgtctgaaaataaaatctttctttataaaaaggcaggccatgtttcattttcagacggcctaaatcattgagaaactaaaaactattaaaaagggaatattgggttttaaaactcaatcggtaaatttttattgtgaaatattaatgatgaaaaaatctttccttacgcttgttctgtattcgtctttacttaccgccagcgaaattgcctatcgctttgtatttgggattgaaaccttaccggcggcaaaaattgcggaaacgtttgcgctgacatttgtgattgctgcgctgtatctgtttgcgcgttataaggtgacgcgtttgttgattgcggtgttttttgcgttcagcattattgccaacaatgtgcattacgcggtttatcaaagctggatgacgggcatcaattattggctgatgctgaaagaggttaccgaagtcggcagcgcgggtgcgtcgatgttggataagttgtggctgcctgtgttgtggggcgtgttggaagtcatgttgttttgcagccttgccaagttccgccgtaagacgcatttttctgccgatatactgtttgccttcctaatgctgatgattttcgtgcgttcgttcgacacgaaacaagagcacggtatttcgcccaaaccgacatacagccgcatcaaagccaattatttcagcttcggttattttgtcggacgcgtgttgccgtatcagttgtttgatttaagcaggattcccgcctttaagcagcctgctccaagcaaaatcgggcagggcagtgttcaaaatatcgtcctgattatgggcgaaagcgaaagcgcggcgcatttgaagctgtttggctacggacgcgaaacttcgccgtttttaacccggctgtcgcaagccgattttaagccgattgtgaaacaaagttattccgcaggctttatgactgcagtgtccctgcccagttttttcaatgcgataccgcacgccaacggcttggaacaaatcagcggcggcgataccaatatgttccgcctcgccaaagagcagggctatgaaacgtatttttacagcgcgcaggcggaaaacgagatggcgattttgaacttaatcggtaagaaatggatagaccatctgattcagccgacgcaacttggctacggcaacggcgacaatatgcccgatgagaagctgctgccgttgttcgacaaaatcaatttgcagcagggcaagcattttatcgtgttgcaccaacgcggttcgcacgccccatacggcgcattgttgcagcctcaagataaagtattcggcgaagccgatattgtggataagtacgacaacaccatccacaaaaccgaccaaatgattcaaaccgtattcgagcagctgcaaaagcagcctgacggcaactggctgtttgcctatacctccgatcatggccagtatgttcgccaagatatctacaatcaaggcacggtgcagcccgacagctatctcgtgccgctagtgttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacgggcaacctgattacgggtgatgcaggcagcttgaacattcgcgacggcaaggcggaatatgtttatccgcaatgagtggcgtaaaaaccaataaagacaaatttagatgatgtcggggaagatgcccgaccgacaagactatgcaaaatatgaaaaaccaagtacgcggatcaggcatggatgcccgatccaatccggccaatgtttcagacggcctgcaaaacagttcgggtcatatcggtaccaacacgcgttaccgcctgaccaaactcggcgaacagatagcgcgcctacccatcgacccgaaaatcgcgcgcattttgctggcggcgaagaaacacgactgcatggcggaaatattggtgattgcgtccgcgctgtcgattcaagacccgcgcgagcggccgctagaagcgcgcgatgcctcagccaaggcgcacgagcgttttaccgacaagcagtccgatttccttgcctatctgaacatttgggacagcttccagcgcgaacgcgataaaggcttgtccaacaagcagctggtgcagtggtgccgccaatatttcctgtcgcacctgcggatgcgcgagtggcgcgagctgcaccaccagcttgcccaaaccgcgattgaaatgggtttaaccaccaaggaagccgctttcagacgacctcccgaagtcaggcagctcacgtcgtctgaaaatgcgggtgaccaagacctatctgctaaactcaaacaaaaacaactggataaaaagcaacaccgcgcccaaatccgcgccgccaaagaagcgggctacgaacaaatccaccgcgccctgctcactggccttatcgccaacgtcggcatgaaatcgcccgacggtaacgactacaccggcgcgcgcggcagccgcttccaccttttccccgcctccgccctgttcaaagccaaacccaaatgggtgatggcggcagaattggttgaaaccacgcgcctttacgcgcgcgacgtcgccgttatccagcccgaatggatagagcaggaagcgccgcacctcgtccgctatcattatttcgagccgcattgggaacaaaaacgcggcgaagtcgtcgccagcgaacgcgtgacgctttacggtctgaccgtattgccgcgccgccccgtgtcttacggcaaagttgcccccgaagaagcgcgcgaaatctttatccgcagcgcgttggtggcgcaggaatgcgatttgaaagcggatttttttgtccacaacaaaaagctgattaaagaaattaccgaactcgaacacaaatcgcgcaagcaagacgtgctggtcgatgacgaagccctgtttgcgttttataacgaacgactgcccgaaatggcttggaaagacgcgcaaggcagcgtttggggaagtgaagattccgtacggattattgaatctgacaaagccgagaggtcgtctgaaaatgagcgcaacgagtttcgtaaaaacaagcgtaatgggtctcgccaaaatgaaaatcacggcaacaccgtaggttgggttgaaaacccaacatcagccgcaactgcaaaaactgttgggtttgacaatccaacctacgctgcccaacaaaccaccccctcccccgtgggggagggtcggggagagggcaaaacagttgccgcacaaaccaacttttccgcaaccgcagcaaaccctctccctaaccctctcccgcaggagagggaacagagtgccgcagcttcaacgatttcagacgacctgcgtcctgcaaatctgcagcaaaccgccccctcccccgtgggggagggctggggagagggcaaaacagttgccacacaaaccaacttttccgcaacctcaacaaaccctctcccgcaggagagggaacagagtgcctcagcttcaacgttttcagacgacctgcgtcctgcaaatctgcagcaaccctctccctcccccgtgggggagggctggggagagggcaaaacagttgccacacaaaccaacttttccgcaacctcaacactttcagacgactccaaacccaaaaagcagcctgcaccccaaaaaaaccgtctgaaacccctacccctcgccgacatccgcaccttccaagcctggctcaaaaccgccgagcgcgacaatccgcgcctgctgttcctcagccgcgacgatctgatgcaacacgccgccgcacacattaccgaagaacagttccccaaattctggcaaaccgcagacggcaaattcaaactttcctaccgcttcgagccgcaccatccgctagacggcgtgaccatgaccgtgccgctgaccgtcctcaaccgcctgcacgcgccgtcgctcgaatggctggtgcccggcatgatacgcgaaaaaatccagttgcaaatcaaagcactgcccaagcaaatccgccgcatctgcgtgcccgtgcccgaattcatcacccaatttttaagccaaaaccccgaccgcaacgcccccatcctgccccaactcgcccaagccatcgccaaaaccgcaggcgacatccgcatattcgagcaaatcaaccaagacgaatgggccgcgttcaggctgcccgaacactgctatttcaacctccgcattatcgacgacggcggacaagagcttgccggcggccgcaaactgcacgaattgcaacaacaactcggtcaagctgccgccgttaccttccgtgacaacacccaagaatttgagcgcgacaacgtcaccgcatgggacatcggcaccctgcccgaatccatcaaattcgcacgcggcaaacaacagctcaccggctatctcggcctacaaaaagaaaaagacggccgcatcgccctgcgcctgtttgataccacagaagccgcagagcaggcacaccgtcaaggtgtcatcgaattgatgaagctgcaattaaaagagcaggtaaaggatttgaacaaaggcatccaaggcttcacccaagctgccatgctgctcaaacacatcaacgccgacactctgcgcgacgacctcacccaagccgtctgcgaccgcgcctttatcggcgaagacgagctgccgcgcaacgaaaaagccttcaaagaacaaatcaaacgcgcccgcagccgcctgcccgccgtcaaagaagccctcagccgctacctgcaggaaaccgccgccgtctacgccgaactcaacagcaaactcggcaaacacccattgacccaccttctaagactacgcctgcaaaccctgctcgccgccggcttcgccacccgaaccccgtgggcacaatggccgcgcctccccatctacctcaaagccatgaccctgcgcctcgaaaaatacagcagcaaccccgcccgcgacgcagcccgcgaagccgatatccaagagctggaacaaatgtggcaggaaaaaacagacagcctgattaaacaaggtctccccatttcagacggcctcgccgcgtttaaatggatgattgaagaattgagggtgtcgctgttcgcgcaggaattgaagacaccgtatccggtgtcggtgaagcggctgttgaaagagtgggaaaaaattgaaaaataaaaaaacagcctgaaaagtttcaggctgtttttttatttgactaatcgaagtttcctatatctatttaagtccctctcaactaatccaaaagttaaatcagcaacatctttgggggatacgtttaaattttcagcaatctgttcaataccaatgccatcattttttaaaatagtaagcattttacgtaatgcgcttgatatttccctttccattggctctggttcgatagttcgatattttttctttgcaaacaaaggacaaagattgtgtatatacatcctatcagtaatcattcctaatttatgcatccgatatgctaaggcaacaagtgatacaccaaatcgtcttttgatttttaataaattttcaatagtgataggaacatgacgatataagcgtagtgcagcctccggcattaaaaaagctgaagcaaaggcattagcctctttttcgataatatcacgaggttcatcttctgtaatttcactatttttactatgttccatactgtatttatcacggattaagtgccctaattcatgggcagcatcaaatcgactacgttctgcagatttttgtgtatttaaaaatacaaatggatgattttcataccaagtacaaaaggcatcaatgtcctttgtatctaaagataatgaaaatacacgaacacccttaacttcaagtagggtgatcatattcggaataggttcattgccaagcccccattctaatcttagttcctgagcagcctcttcaggagaaatatcagaaaaatcaggcaatacggcttgacttagtgtaaattctgtctcgagccagtcatttaacaaaaaagccgtaatgctatgatttaatgcttgtttttcaagcctcttcgaggtgcgtgaacgagcacgaaaacttactgcctgagatttcaactcaggcagtctttcgtcattagtaaagaaatgaactggaaactctaataaattggctaattcatttaaatcaggtatttgctcatcttttacatagtttctaacctgtcgagcggtaatacctaataactcagctaattttgtttgcgtacaaccacgtttatccagcgcaaattccagtctctcacgattaaatgtctgcatgatttatcattcaaattatcctgctttttgttttctttcaaccaaaggctcatattcttcaacaggttgcttacgttcaagctcatcaaatttagttaaatcaacatcagctaatataattcgctgcttgtacccagttatttgatgactaacaaaaccactcggtaaagataattcaagttgcactttattatacttccagtgaaacagcagaacccaaaactgcacagtatcaggcaaatctagttttgaattacgaatagcctcctcaaatcccttacctttccttgcggttgtcattggcatcccgtgatgcctaccaacatctgaagtagcagtagccacaataatacttttagttcgacatggcgagagacatagaaatgcaccacccgaccaaggctcaagcgtccagccatctttacttaaatatacccttagagcaaatgtaatttctgcttgccgatacatccccaatgtatttctgtcagataatgctgctttgtcctgaatattattatgcgcagtaagtacaatctctttaagcatctcctgagataagtacttgctgatttcacttaaagcaatatcactattttgttgctcgactatttctcctacttcaaatgggaaaggttctgataatgcaaattccaccataaaaatttcctaattttatacgtaatgtttacacaatatatcaggaaatatgaaaacgtacaactatatctataaagcaattaataagtagcctgcccaaccgtgtccttatctttcggcacacccgacctgcaaatcacgcaaaacttggaatccgtgtgtagggtgtgtgcggtacatacgcacgcagtctttttaaaccacagcccttcccaactaaaccaaaaggtcgtctgaaccctattttcagacgaccttttgccactttgtaaaacaaatcttcccaccatcctctccccaaacatcgcccgaaccagtaaacttctcatatttcaacaactccttggaagcaaaccatgtctggtatctacctaccccgcctattcccgccccatatcgccgaacgcggcctgttgtattttcagcagggcaaggttctcgatgtccgaaaaacttccgccgggcattatcgggcggaggtgtgcggttcggaaaactattgggtatagttgaagctggatagtgatttgtatattaaagacgaaggctgcaattgtccttatatctaagagtgcaaacataccttaaattactatattgcataggcaaaatacaagcctataacgaattggaaacaaaatgccgtctgaaaacatcttcagacggcattataaaatctgttcaccttttcagatgagtaatgtacacccttatacaatttttgctactatgccccataaatccacggctaaagatatccttattatgtcctatgatttatcgaaacgacttgtaatcggcttagcatcaagtgccctattcgacttatccgaatcggataatatatttagaatggaaggggcagaaacctataggcaatatcagagagaaaaacaaaaccatcccctaaaaaaggcgttgtctttccatttattaaaaaacttctgtcaatcaatgaaataaacccaaacgacccaacgattgggtttattcttttatccagaaacaatccagatacagattacgagtcataactataggcttaatattacacgattctcattccatcaaggcggaaaaccgcacaaatactgaaacactatcgatcgatttgtaaacaagcctacttaagtaacttgcagtccttatcatttcctttaaaataatccagcccgtcactacacgaactggcggacttcttgcaaataaaggttactagattttcattcatcttaataataaaaggatttttatctttatctatggctaccgccttcaacatgaatttactgtctaaagccccgcgcgcgattccattcaaacggatacaaaagccttctgcctctttaatcggcaaacttggccacttggtagatgtttgtttaaacctcccattctgcagataaaacttttccataaaatgtgcattttctaacaaggctgcccgcactgcatttatctttgctttctcaacataattgcgatagctcggataaacaattaaagcaagtacagacaatatcaagaccactgatattaattcaaccagcgtaaacccccgattatcagtcattactttacttccaataagaacagattattcaacatatttctttgaacagacttactatcccattcaacagtatgcatatttcccactctattttttagcggccggtatagccggtttggctgggccttttggtgcgggcgcgccgaccgaagcctggtccttcagcttcgccagcaccgcagggccgatgccctttaccttggtcaaatcgtctacagacttgaacgcaccgttttgcgcacggtattccgcaatggccttcgccttcgccgggcctatgcccggcagcgcctccaactcctgctgcgaagccgcattgatgtttaccgccgcaagggagaaggcgcaggagaacagcatacagaacagcacgaacattttcttcatggtttttcctttaagggttgcaaacaataaaccgcatcttgcgacgataaaacgagtcattctaaaatgaatatcccaaagtttcaagccgttcctccgcaaacccgaccggacaccgtacggatgccgtcccgccatcaccgacattttttccgggcaaagcaaacattttttccgggcaaagcaaaaacccccgaataatcgggggttttctgaatgggtgtttggcagtgacctactttcgcatggaagaatcacactatcatcggcgctgagtcgtttcacggtcctgttcgggatgggaaggcgtgggaccaactcgctatggccgccaaacttaaactgttacaaatcggtaaagccttaatcaatatattcggtaatgactgaatcagtcagtaagcttttatctcttgaagttcttcaaatgatagagtcaagcctcacgagcaattagtatgggttagcttcacgcgttaccgcgcttccacaccccacctatcaacgtcctggtctcgaacgactctttagtgcggttaaaccgcaagggaagtctcatcttcaggcgagtttcgcgcttagatgctttcagcgcttatctcttccgaacttagctacccggctatgcaactggcgttacaaccggtacaccataggttcgtcgactccggtcctctcgtactaggagcagcccccgtcaaacttccaacgcccactgcagatagggacaaactgtct

SEQ ID NO: 37863 - DNA, 3959 bp, Neisseria meningitidis
ctatattttacaatttttggtcatatgaatgtctgttccgttcacaggcaaaccgtgtttaaacgctgtattacagcaaatcatcagataacgggccggcagaaaaaatgattccgtctgatttcttattccaataaaatcaggttagatgatatattgccgcttctgtctgtcagccgtttcgggctgcacaccacatctgttcaaaggaaaaccatgtttcaaaattttgatttgggcgtgtttctgcttgccgtcctgcccgtgctgctctccattaccgtcagggaggtggcgcgcggctatacggcgcgctactggggagacaacactgccgaacaatacggcaggctgacactgaaccccctgccccatatcgatttggtcggcacaatcatcgtaccgctgcttactttgatgttcacgcccttcctgttcggctgggcgcgtccgattcctatcgattcgcgcaacttccgcaacccgcgccttgcctggcgttgcgttgccgcgtccggcccgctgtcgaatctagcgatggctgttctgtggggcgtggttttggtgctgactccgtatgtcggcggggcgtatcagatgccgttggctcaaatggcaaactacggtattctgatcaatgcgattctgttcgcgctcaacatcatccccatcctgccttgggacggcggcattttcatcgacaccttcctgtcggcgaaatattcgcaagcgttccgcaaaatcgaaccttatgggacgtggattatcctactgctgatgctgaccggggttttgggtgcgtttattgcaccgattgtgcggctggtgattgcgtttgtgcagatgttcgtctgactggctttcagacggcataaacgctccagaaaacgcggcaggacatattgccctgccgcgttttcctgtagtgtaatcttatttttttcatcattattagaaccaggttgcatgataatacctttcattaactgaaacactgattaagaaactccagtctgtctaatgatgaggttttcacatcgccaaaacttgccaatcaaatgctggatttattgccgtctgagatttggtcaaatccaaaggcgacattcttagaccctgtgtgtaaatcaggggtatttttgcgtgaaatcgtcaaacgcttggatgaaggcttgaccaatcaaataccagataaacaaactcgcattaaccacattttaaaaaatcaagtttttggaagtactgccacgtatgtaggtagctttgaccgatatttgcataaaaactcctttgctggtgaaaggaattattttgccaattttaaaatatttctggcaccaaatagtacaatgacaaagacaatcatgccaatgattaaatcaggatagctagaatgagtcaataacgtcaatgctcccgccgctatcacaccgatattgatgataatgtcattggatgtaaaaatcatgctggctttgatatggatttctttattttgatttttgctcagtagatataagcacagccagtttgcaatcaatgccaaaaatgccgtgccaatcatcagttgataattgggcagctgctcagcaccgataaaacgcctaatcacttctatcaccccaaataacgccaatattatctgcgttatccccgccaaaaatgccacacgttttttatacgccagcgtcataccaatggctgatagcgccaatatatagacaaagctgtccgccagcatatctagactatcagcaatcagccccatagaattagcaaaaataccaaccgaacactctatgataaaaaacacaaagttaatcatgagcacttgatataataatcttttttctaagtgctcatcaggcttgttaaacactatcttatcaacaatcacttcggtggaaatgatatgactatcaaaattaagcggttcaagtacttgtaaaatcgttgtatcttgattatcgtgatagacggttaagcaccgcccagcaatatcaaactgtaattcataaatatcagacacatcttttaaacgcatgcgaatgagctgttcttcggacgggcagtccattttggtaatgttaaaaatggtctttttcatctatttagttccttgttttgatcaggttggctcaaataaatctgtgtttatattgctgcttggtaatttttggatggtttgagtaaattgattaggttaaaatttacctttggaagtaccgccacgcataatagtttagatatgtttataatctctggataaaaaaacgtaataagtgcttactggataacaaagtccaaaccaatagcaggcaaaataaggcatccaccccccttcttcattaaggatatatattgagaaacaaatcgcaactaaacagaaaaaacttgggagataaagccatttcattcccctattcaagaatctagccaagataggtattttgtattctacaaaaaagaaaggcatttccaagggaaacatgtcagataaaaacttttgtttattttttactatagatagaaccttgcttctcaagagaaagccattaataataccgatgacagctattaatatatagagaatagtataagtatgaataatcttcattagacaaaaagaagaaatggcagataaattacatacgatatattggaatataaaatatttacggtctaaaccttgttcagttgcaatttttttaaaattgccttgcataaaaaaatcaaaggcgtccattaaactatctttcacattagaaatttaaaagctaaataatacgacaaacaatgtgaagtactattcatggtttatttaaaaaataatactattctgaacattatttagatacagaaattaacaaattagaactaaacaagcttttaaatactttaattttattggaaagctataaaaggaactataactttacacactagtcacttctttttaagaggcaaaagggattgggaaggtcgtcttggagataagcactggtatttcggccaatggtaaatagagtttacctcaaatagggtagaacctccttcatctgtcagttaataacagccacttttacaatgccctgtcaaaataaagcggcacgcccgatttttcactcatcgtcatcaaataacccatcaccttttggggccattcgatgccgcgcaccacggtcagattcctcaaaacggggaaaaccaaaatatcctccataccgattccgccgttgatgccgtctgaagcaccgtccatcaaattttccaactcttgcaaatctgcgtttatccgttcgaggtattgggcggttttattcaaattggcggaaaagctgccgatgcttttctcttttttgtctgtaaaatatttcaccgcttccggcgttgcaaattcaggcagcccgattttgatcacgcgcggctgcaccagtttgtcgttgtatccgcccaccttgtccagccacgcccgtatctcggggcggacttcgtctttcagacggtcttcgcggtcgaaatgccgcacaatgtccaaactctcgcccataaacgaaccgtcttctttttgcaggacgggcacttgtttcgcaccgatcataccgatcggcgttgcctcgtcgtcgtttgccagcacggcttcttcaacgtccgcgccaaacagcccggcagccatccgcgcacgcacgcaaaacgggcaatggtcgtaaatatacagtttcatcaaaatattcctcgtcaacctgtcggtaccgactaccttaacaccccgcgccgcccgaaacaagtttatcttcccgcctatgcaccgtaaataaataagctgttacaataaactcgtttttatcggaacggaagaccccatcatgaccgccatcagcccgattcaagacacgcaaagcgcgactctgcaagaattgcgcgaatggttcgacagctactgcgccgctctgccggac

SEQ ID NO: 37864 - DNA, 801 bp, Neisseria meningitidis
tcatacatataattaatatagagcctcaagcagatcaattccaaatatatgctgagtttgtagctatgttaagtttcatggatttctaactctaatccttatctttcgaggtgatgattgtcttggtccaactcaaattgttctcattctatgaaggacaacatatcttacttggaccaaataagttccttaatctttaaacaaaatcaattggcgttagtaaattaattcatgtcctatacatattactctaggtctaagcttacttcaactgacatgggatctcataatcactggtttactttagtcaagtggtaaatgggaaagaatcttggcaaattgttgaaagggaagtggcacacaagagaaagtaagaaaccgataggagttattattccttcatgatcagaagtgagattgagagaatctcacaaagacaatcatatcttgttgtatagtgacatgtttcaagaatagggtttttaattgttgacacacacacgatccaatccatcaaacccagcctgatctctttttcgtggctgcgaaaaataccgtcaatcaagagaagaataagcatatctctctgcttattccccaccactttgggctatctcacacccacacccttcatctgagcatgattcttgaacaaaataatattcttcgagagaaaaagtaaaagcttggtccacataaattgtaagattctaatccgatcatgcataaaaaagttgcaaatacatatataaaacatgtgcggatgtaccatattctttagcatctgcaacaaagaaacat

SEQ ID NO: 37865 - DNA, 502 bp, Neisseria meningitidis
cgacccgagtcttcgagtaggacccacctctgaatctgtgacagacgccggtttcgttctctctctctcctttttttcctctctttgcttttccaaaaaataaagttgtctttttttatttataataaaatgatttgttgtttcacagtgtgttgtttgttttggggtaaaaaagaaaatcataaggatgctttcaatatttgttttgttttggttgagtgattgctgaagccaacttaaaagagagagaagagaagagtgactctgtgtgtgtgtgcaagaaagtcttctctttcacacctttcgttttctcgaacctctcctttaaagatggtggaggaatcttgggtttgacaactcattaacactgaccctctttttagctctacaagcatccaaggaacccctcttacttttccctcttcttcattccctctctctctatatctcccaattccttctctttttttaaccttgatcttcttcttataagagactcaga

SEQ ID NO: 37866 - DNA, 663 bp, Neisseria meningitidis
tagcttgagaaaagactcaagtttgtctgctcccacgcccaataaactcgcataaaagaattattcttgttgtatgaccttcttccaaaacggaacgccatccctgcatgtaatatatacatgacacaatattaatattctttttactctgtagtttgaatgtggtatttcgtttcttttctcttttagtttcagaaggcttgaaaccgcaacccacttcacggctcattaagctctctatcatacagaaaccatattgtaacagatgtactggaaaagaagtgaaacatgataatgacagcgagacgtatcatttactctagaggattgtgaaaagaaaaaaattacctctgagaggcactccaagagcattttgcagcattcttgatgaagtggaacaactccaaaccggtcagctagaaagagaagatgaatcaactcggtgccaaaattcacagtgtcttccatgttcaactctccactatacatgaaattcatcatagccttgaatgcttctggtgatacatcggttaggtaaatcgttgatgaatggctttcactcatcccatttgtaaacatctggatgttcatagagaataaataagaaaattgagaatcaatatattcatgtacatcagaactgcgacactaaaagagattctc

SEQ ID NO: 37867 - DNA, 945 bp, Neisseria meningitidis
tttgcattcaggagtagcggttgacaaattcagcaaattgagaatatccagagattggtgttctcttaagtgttgattactattgtttatatcattactacagctctcagacccaactgtgaactgatgctgttgctgtctcctctgctcaaaatattgtttttgccttcaggtgcaacaaagatgaaattaaaagtgtaagcacaatgggaagcatatgctgacaaacatctcataaagagaacaagaaggagcttacacacctcttcttcactgacgtgtgtgactgattaccccaaaaggttcccagaaaacaataacaagtcaaaatgaaaacaaattataagaaaaataagctattatcccaacaccaagaggttttagcttcaccccatttataacggacctctgaatttgaaatatcactaaaaggaaaaagtcactcacagcggctactttccgcctcgatcctcccatccattgcagcattcgtagaaattccggttcttagagttttcaaattgtacractgcacaaagatttcgaaattaaaatttcgacgccaccacgaacaattckacccaacgattccataactaggttgcgattcactatcaattagacactgagactgaaaattttgaatcctaatcctaaatttccgatcagatctagaagaatctaggtaaaatttctacgaaatccctcaaaaaacatacagattcgagagaggagaaagagatatatttagaaaattcgagaagcttcgacagtatctgaatcgcgtccccaaaacggagctcggagcatagaaacgattacgagaacttgataattgctgctaccgaatgatgaatccgatgatctttgatcaaatttgcagcaggggaaatcaaagacaacgacacgaacggtctttcaaatttcgaaaatttcttgtaagca

SEQ ID NO: 37868 - DNA, 423 bp, Neisseria meningitidis
cccagtttgctttattttgtaaatcgcttgtgcttgtgtgcgacacctcaacttgagagtagtatgttattgagatgacgcaaaatttatacattcttatgttgtacctgttatactttcaccaggctgaagaattaagaaaatgcctttgggaaaaaaatgtaccagcaaagggtatatgttgggaatgcggtattggcatccattcactgaggaagccattgaacaggtatgttgaatatggtgtttggtagtatcttgatttaaggctaaaacacaaagttttcttttcgtatttgcatcttcaaatatttgcttacatttaaagtaaaccactacattttgtgtttttatcaaacagcatttgcaaaataatgattgaagtatgtgtgaacacctggagtttgcactttgtgagtctta

SEQ ID NO: 37869 - DNA, 407 bp, Neisseria meningitidis
aggtcggtatccgtttcagaacctggtatttaagtggcaagaccccaagcccaattgtaatgttcagtatgttggtctgagcagctgggataaacatgttggatatagaaacgtgagtgtgtttcctgtgacacataatcatatcttgctgtggaagcaagtggattgccgtgaagttagaggagatgagtctggtgacgagaaagttgtggaggaagggactggttatgattatgaacaatggggacttgggaatttcttggagagttggcaattatctgacacagtcttccttgttggtgaagaggaaatggatgtccctgctcacaaggttatattacaagcatcaggtaattttcctttgagatcatctgatggggatgtcattcaacttcgtggagtgtcgt

SEQ ID NO: 37870 - DNA, 637 bp, Neisseria meningitidis
gaacgaccattatctggagaatttcatgcagcttaaacgtgtggcagaagccaaactgccaaccccatggggcgatttcctgatggtgggatttgaagaactggcaaccggacacgatcatgtcgcgctagtctatggcgatatttccgggcataccccggtacttgcgcgcgtccattccgaatgtctgaccggtgacgccctgttcagcttgcgctgcgattgtggcttccagctcgaagcggcattgacgcaaattgccgaggaaggccgtggtattttgctgtatcaccgtcaggaaggtcgtaacattggtctgctgaataaaatccgcgcttacgcactgcaggatcaaggttacgataccgtagaggctaaccaccagttaggcttcgccgctgatgagcgcgacttcactctttgcgctgatatgttcaaactccttggcgtcaatgaagtccgcttgttaaccaataacccgaaaaaagtcgaaattctgaccgaagcagggattaatattgttgaacgcgtaccattgattgtaggtcgtaaccccaataacgaacattatctcgataccaaagccgagaaaatgggccatttgctgaacaaataaccctcttgcattgtgtaattc

SEQ ID NO: 37871 - DNA, 827 bp, Neisseria meningitidis
tcatattcttcaatttcttgctcctcaatgacaacgatggtaggctttacactaggagagggacgaagcaagtcctgagcttcttcccaagtgagtctcagctccatagattcttcactatgcaaaagaagtctcttattttttgcaccaatggttcgagttctcttcttctctttaactcgtgtaggatcatcacctatcctgcccccgttagtctcactgttcaaattctcaggcataccattcaactctttcggtattagtgaaatacacgaggaaccatttatggagggtgggttttctgttacaccagacgatgatgtgtcctcagttgatgttccgttggtgagcccacaaccctatttataaatattgtaaccggataagaatggagctaagcagaaaataaaaaccagcacattcctacagaaaccagttcatagaaaccccaacctgcatgtctccagcattagctgccttcctggaacccatgattagttttccgccaggatcaacccgactgaaagttactgtagaggtgaaaaacacagaaaaccaacaatagttttagaaaatggttcatgaaaatttgatgttaaaaccagcaaatgcttgaagctttagctaagacatgaactatattaaaagtacctgtatcaccagcctgtagcatcatggactgtatgcatggagtgacaccttctaaaacatacattctactattgttattgggccaatatctgaactggaacgtccactccctacccctcacatcttggattttcaaaggaatgcttcggattgactaatcggaggaaaatatgcct

SEQ ID NO: 37872 - DNA, 467 bp, Neisseria meningitidis
cccacttaaattgaactaattatgtgtttgcaaaaaacttaaataccacatgcaaaaagtttagttttattttaaacttttaagcaattatgagctacttctcaactgtccatttaaaatgacatgttatatgttctttttttgttgctcatagttatgttataattgtttttttattattattatgagattgtattaaaagctcaaagagctaatgctatagtttttttttttctttttttgtcatcattttaaaacgagaagtgtagccaatgctatagttaaatattatatttaatactacacaaaaaatcaaggttattcaattcaaaagaaaaccacaatggacaatatatgccacatttgcacctgagaaatgaaatacatccatgttttcaaatttacatttagccccgttataatattaattacatataggacccaattttgacgtaaggtgaatctct

SEQ ID NO: 37873 - DNA, 837 bp, Neisseria meningitidis
gttgtctggcattacaaattaatggtttagctgtcaaattcaaaaaacatgattttatccacaatgaatctagtaacaatctacaacaacaacaaaaagaatctagtactaaaattggggtcaaaatctattgttaaaacttaatcctcttatttgaaacttcatcttatcttaatcctcttattgctcttttagttgaaacaactctcccacttttggaatttataaataaattttgcaagcttcacatggagtatagtgtgataaccatataaagtcacatgcggctagacttgagagtcgacacatatgtttatgtgcaatgtattggttgggcttcttaattatgaaacaaatgggctttgcaataacaagttaagtttctcgatcaagctaagcaatatctcagctcgtgtgttgattgtttcttttcttggtcaattccatcaagctatatttcttctagtcacggtttcgtaccgttgcctctatccgaatccatgcaacctccccaaccatatataacagataagagatttgcacaaatgacagcgaaatgtgctaaactcgtctggcgtttcctaagaagacgacattattgtgtgaattggaagaagcgtgattagggaaacttgacgtggactttttgggctattgacaaataataaccaactttggcccaaactgttcgtattaatttgtggttcattttgttttctagttgcatcttttcttagcctttgtcccctcggtttagccgctgtgaggtcgggaccgttgttaattattgtaacaccgcataattacataataatataaactcgcaaaataaaaaaa

SEQ ID NO: 37874 - DNA, 632 bp, Neisseria meningitidis
tgaacacgtaagtctacaagttctaatttaaaatcacagtttttctttttatattttagaaatttttacggacggagatggctgtggaatgtggatgtacataatctataattttattttacagttctccaataacattaggtgaaattttttccccgaaattttcgacttcgtgaaaattggacaaaaaaagtccataaaccgttaatttcgtgttgtgatatagatttgtgggtcgtaaataatactagcaaaatccaacaaaacttttgttttcttgtgcttttttctctttagatttttttgtgtgtgtctaattttacatatgcatgccctacagataattcctatttatgcatctacagaactcaattatcgtctcagtgataataaatgcagtaactgtaagaaacggacgtatcaatttcttttcctgacagattgaaagttgtcttagagaaatcggtacttatataatgagcatatcattttctcagcgtgaaatcagaatgaaccatttatgattttacccactatatattaaaagagtaggttaggagaaaattgatcctacgtggtacgtattagctaagaccaattcaaaaatatgaaattcctctaatttatcatta

SEQ ID NO: 37875 - DNA, 822 bp, Neisseria meningitidis
ggatgtacgattagagagaagtaggaccatggaagttagggaagtaggaacatgtcatagataaggcccaccccaaatatgtggtcgtgcttcatcttagaacctcgtggtgtttggcttagctacgtcgtcaaatcatccatcagaatccagtttcagttttgtcttccaatcatgtttatacacgtgttcctatcgtctttaaagatatctcacgtctcttacattgcctagttgccctaataattttctgccggtgcgactagttttataagactatttgtagtttgaatgtgaagattcacaaaatgggtcttcataaaaagttaaaaacccttaccagttttcgtgatttttctattttgatgtaagtttctgtgaatcgatgtgataatatgtcatgtgagtcttttttctccggctgacatagtaacatgtgatttgataagaaaattattttagtatcgtgataaattttgtgaggtgtttaactttttgtttaaatcttaatgcaaaaacttccaaaccctagatttcttttttgtaattggttttgcatcaaaacacaatatccgaatgtaaaatattgaattagctaaacagtagatgtccactagatcatgagtaggcgatatacatataaatttcattaattcagagagaataataattaaattttgtaaaaaggtgctaaggcaaggtcttaatacaagtctaaattattcagatgaaaaattcatgttaggaaataggttggaccataagaggatggtgctatcaatctattaacaaaagtacaaataccctgagctgtactgccgg

SEQ ID NO: 37876 - DNA, 485 bp, Neisseria meningitidis
  misc_feature (468)..(468): N is any nucleotide
ccctgctcttccgttccatgtttctgcactttttgtccatccccattcccacattgtcaccggtgctggtaactcccttctctgtgaatcatacgttgctaataattcttctacactcccgagcggaactaacgactgcccaaccagaaaagaaaagaattagaagtgaagataacagattcttttgtggagctttaactagatgtaagatgaaaagtgtttgttacctgtcgagcttcaaggtttgagacagccatagcaccaacgtatggaagactttccacaacagcatctgccaagtcagatataaacataggttctgttcctagagcaggtactcgcccccagtttttgataccagacttcaaagccaactctttatactcaacatctatctcctccagagtttcaatgtgctcgcatcacaaactgttaaaatagaaacaaacgtgagtttcaaataaccangagagagagaatttgtg

SEQ ID NO: 37877 - DNA, 1156 bp, Neisseria meningitidis
ttaaaaagggtaagtggatcctgaccctgtatatgctgaatgaactttgtcattttctgttaaattaatttcgctgatgccatctatgctttgatgatgacgcagttagaaaacagcaacctaagcaaagaaatcccagtattcaatcgtcttgtaagttcttaacatcttctatcgatttggggattatttaatttgtcatttcaagactgattttctctccaagccctcacttattttgtcttgtgtacagttgaaggaggctgctagcttcctaacatccggattgatatccccaggaaatgaaccgatgtatgaattacatagtcatgtatcttaggattgtaaacatctccaggtttatatttccagacttctcaattattaaagcttttcacctctagttcaagattccaacatcggagatcgagtttcaaggagcttcagtacatacgtgatggggacagcaatggggtgctgcactttgtgggtacatcttatggtagtcatcagtgggtcaaccccgttctcgcaaaggttaacctcacttttatcttactttctttattcatattgttggaaatccaattaccatgacaaggaattctgctggagaaaaatatttccttatttgagttctttatgttttacagaaaatcaacattacatcgagtagtcccacatccagattcactgatccaaaggctttggcttcaaaagcctatgcggtatggtccacccaagttcgctcggattatatgactagaatttggcttgaactacaaaattgacgaagcataaaattaattgaagtgaaccttctttcctcttagatacagtatttaaccatatgatttcatttttttggcaccagggtacttcctttgcagggcctaggatggaagacggccatatatcatcctggtgggtggtggacttaggcgaagaacatcaggtctcctccataacttctctttctacatactctgttctcataaagacacaaacggtctaaatgctccatatgtaacccatactcgcagaaataagagaaaatgtatttgagtaaaacaacatttactttaagttctgaaaataatataacacggtgaggattcctggttgcagcttatgtgcaactattacaccttcagac

SEQ ID NO: 37878 - DNA, 749 bp, Neisseria meningitidis
acattcaccaatggaagctaatgttggtttttaaaatactcgaaccatattatctagagtcttctagactattctatcacttaacaaacatgcagtttgattacgagtttttctcgttacggatttagtgatgagctagtaaatgattattgattgacaaaacttataatatggttaatgttttccatctaccatttacgaaaaaggtaacaaatttttgtcactaatctttcgataaacacaagtatgcaattttatttttattttttgtattctctacatatgctaagaatcttaattaaaacaataagaccttacactagttttgattatttagaatacttatccacatcccttactttcagtacaaatgtcatcttcattcttccctagacattatttaagaaatatttacgaaattttacgaaatcaaattaataattgtcattgagacatttaaaagtttatcactaaactaattccctaattagggataaattttcatttcttatgacatacaaacagaaacgtgaaacacgtaggccctctttgttaacctcctcacattaataatttgtcgtaaacatcctcacattaacacttcgtgaatgtttagttctaaagagaagaaaaactttaaatatgtttagcatatatttagttaactttgttctatgaaatttaaagtaattctttatgtcttatgacatttaaaagtttatcactaaattataagcgatttgatctac

SEQ ID NO: 37879 - DNA, 1558 bp, Neisseria meningitidis
tcattgtgactagccaagtagccatgctggacactaccaaagtggtctgagccaagactttctaccttttgtttttcctagtctagacaaaaactttgcaaataaagtatattagtaggctgaaattttccttgttcatttatttcatcattctacacaaactaaaaaaaaataaaaaaaataaaaataaaataaaaaaattaggaggtttagtaaataaaacggacaatgaaaaaaaacacagaagagaatgatttatatatgttaatagtactaaggaactttggatccaacaggaaaacgtaaactgtggaacaccacgatcaagtactaaggggttaatcctttttgactcctcaagcgcaccatgaacactttgatggaaacaataagcaactcaagagattagaagatgggaaagttttatcactatatcaatgtatatttgttaccaactcacatagttaagcaatccgaagattgtgcgacggaagtgatgggccacacgaaggatcaatgaacactttgcatgagacgatggcacaatctcactgttcggaatatcagcatgatcatctaccatctttaaaatctaggatttgcttaagtgatttttttctttcttaacacttcgccaaatggatctatagatctaaggtttcttcttcttcctccaaggattatatgtgggttttagtacttctcaagttatctcgaatctggttagttttactaacttactattttactagcaaggaaaagtccaataatacgacttgtgtagccaaaaaaaaaaacacgacttgtgtaaatctggaaatgacgataataccctcgtaaaacctaaaactgtgaggagagaagaaggtgccctttttgtcccagcaagaataaatcacgtcggccttctttgcccttctcctttgtccagattttcttcttcaacctctttctctttgcttacccgccaaattccttatctttgaaattgcctcatccctttcgcgtttggtgattctgaagattccgcttcatatccttttgatctgtaagtttcgatttccgatctccttcgtttgtttcctgtcaaatttggttagaaattgttccgagcattgaattttctcgtacatgatctctgtttttaatctgtgtttgtttgatcaagttgtgaaatttcgaattgggttttggtggctcaagggtgttttgttcgttagctaaatccccaacagagagctttcaatttcagagatggtggtagttgtaaaacttaggctaaaacattaatctctgctcttaactagtgttggtttggatttttgttagaaacaatgattggagcataagtttttatagaagaatgcttccaagttagttgcttttgtgctatatcttgagggcttatggttatacaacttatagctcttttatttgttttttgttctcacttttctgtcaaggtcttatgttagtgttcatactttgttttcttctttacaggtctataaaagacactactggttgaattagaatctgtaagagatattagtgtttt

SEQ ID NO: 37880 - DNA, 860 bp, Neisseria meningitidis
agcgatgaaggcactactcttttgcccatctaactatctaaataggcctagtcgaggataaacctttggttcttttcgttagttaataggcctaggatttgtcttgtactaattaaatgttgtataataatgtatacatatatatatatatggttctttatagtttcacgctgagacatgaacattaactgagacaactttaaaccttgaatataattgagcttgttatacgtgtcagtttcttattacatcaactgaatttatttatcactgagacatttattgactccagtcataaatagtgcgtatatgtataattgtgtaaaaaaggtatgtaaaatgtatgttgagaaacaaaaaaggtaatatgtgtagaatgctaaaaatgaaaacaaagtacaaaaaatcagamctttcattggtgtggcatagtggttactggctcggatctactaggacgagtacgatttcggcccacgtacagatctaatatcaccgcaccaaattaacagattgttggagtttgtccaattttcaagaagtagattcaaacaatactttcagaaacggaacaaaagatctaaacgatattggaaaagtctactgttgtaactttcctcacaggaccacatccccatctccgtcagtagaagaaattccaaaataataaaaataaaaactgagaataattgatatgtcaaataaattagaactagcgatatactgcagtgaatagtagattaaactatgttagaatttggatgattctacataaaaccccaaagactagtaaattagtcatgacgcattagtggagaacatttttctacatttaggaaagatcgaaataccaccatttt

SEQ ID NO: 37881 - DNA, 467 bp, Neisseria meningitidis
ctgttatcgttgcgggtatttctcaatctctctaatttcctattctaaactccaaatttcgtttgatttttgactaaagtctcgatcttttcgtgaccctcttcttgattctctgtttagctcttagtttgttcatgttctgtttttttgactacgtatatggtttcttagtgcgaatcttgactcttttaatctataaatagggaaaaaatatgtgactttggtacataaaagggaaaaaattgagactttggttgtaatgattttgttatagatctgcgtatgagagttctctattctgtgaacaatttcataaggaccaatctggttggagggaatgctatttgtgtagcaaggtgcgttttttgaaactgtgtgaatatgtttgttttttctatatatagagtttagtggtgatgttttgttgtgctgattgagaatctgtgaagacagagactacattgtgg

SEQ ID NO: 37882 - DNA, 468 bp, Neisseria meningitidis
atcccccatcttcatcagctcacttctcaacgcttcgctcttctccgctaacgtatatcagcttgcagttggctacgtgtctttaaagcttcagggagaacaactactgctctttcttcttgttctgcgactccacttcttagctttaactgatcgtagtaaagagcgtgaagaacaatgtttactggtaatctcttgttctgtgaagcgtgaagacgtgcgtcgtaagaaagctttaagggatccattgagctacacactttttccctttcgatctcgtctagattcggatgagctttcaagaagatgtctatagctctgtagagatcgtcgtctgattttctagcggatttcgggacaagattcgcaatcgcgttgaatttggagattgttaggtctccgtaagtagcgatctccgctaagtaagaatcaactgttttagctactctttgtagtgaaacagagcag

SEQ ID NO: 37883 - DNA, 1698 bp, Neisseria meningitidis
ttttttttttttgggtgaatttttttttttgtttcaatttaatttatcgatgtgaaaaattaaaacttttatgggtgagatagagagagaaagagggagagagcattcaagtgaacgaaacgcataaaatgcatgcacgacacttgaagacacacacaaaactcgaaaagtaagaaaactcgcagagatttagaacagacacaaagtgaaagactttggtttttttttgactttgttaagatatgtttttttggtatataatatatatagaaatgaaatttagggttggtaggaatcatatattttggaaaaaaaatagtatggtgacgtaattttaatatttggttatatgtattcaactaatttataggtattttcctttctacagttggggtattatttatataaggaaatattgattatttcatcaagaaaagaaagaattattcaatagaaacatatatgtttctttttgcaaatcataaatatatagagtgcatgcatgacactaacacacacatgcacaaaagactttgaggttcttctttttctcttttgactttcttggtttgttattgtcaattactctaagaaatcattttaatttaagtttgtaaaagttataaaaattatcctaagaaaagaaaataatagtacataaattctacttatctaattaaagattataatagaaatttgcgatcgcgtacatgtatatgctatatactctacctgtcgtcattctctgtatatgtattctaaccaaatttgagttccgaataccctaaaacttagagtggattgagaccgatagataagtaaaaattgacgattcatatcaaacatgtagtcttatggtagaatatatattccaaaataagataccaaatttatagagaacttgcaaacgaaatgggaagaattggtggaatataaactaaaaattcattcttgcttaaattgaatttttttttcctacactgaagaaaacaaaattagtttataccatcgacaaaaagaaatatgcaaaaaatcaacacaatatattttgtaggatttgtttattttttgttaatacttttgaaggatttgtagttaattgaatatatatatatatatataatatattatgtttttttttttgccattttactacatttaaccataaccttgctatttatggagtccaatagtccatgcgcatgataaacatacagtataagtgttcacacgattttatatatgcatgtgattttctgtcaaataacacgttactacccaagaatatatcatctatttgttctaacttttactcatgcatgctctattcacttcgtatttcccattaaatctttaatcttttctatctaattagttcaaatttaaatctaactaaaatgacaccatatcttttggaatcgctctcttttgggtggaatcttctatattatcaacgagctactattaagttactacgttttttcactcccttttttgaccttatatatagctaggcttgtaacacctatcgagtaattgactactgttggaacgagtaaaaaacttataagttttaactcagtgtaaaatgtcgccgtctgggtaaaaagagtggtaatctatgtattaacctaaatttcattatacacttatggaattttcttgttgacagcaaaatatatagacataatccatttt

SEQ ID NO: 37884 - DNA, 794 bp, Neisseria meningitidis
ttgtccaactatctactatacttatgtgaaaaatacatacatatgcccaaaattgttatcaaaccaaaatgttctggaaatagcccattggacatctatttataaaattgcatacactttagctaaaaaaaagtacttcagtttgttgttagaatattcaaattcaagaattatttttgaaagaattgtgtgcagaatatcaaagaaattttgaaataattcagaattgtgtacacaatatcaaaaaatccatttcgaaaatgctttgtacacttgtgttttggcttgtatttttattttaaaagtatgatatgtaaaataaataggaagtgtaggattattctttttcttgtctaataaaaaataaaaaataatcatatgcatttatgaagataattaaacttttaaatactttttaatatttcatacatattatccatttctcattccaaaaaaagagtttaattctcagtttcagaataaaatgtgggccttatacagatttagttggcccattaatgtacaggtgacaataatccaccaactcgtttctcctgacacaaaaaatatctcatcatgtcttcttcttcgtattcgtgtctctcatttccttttttgactcttctttccaaaaaggattagatctgactcactattacgtgtcacgcacagttcattaggtacgctcggaaaattttatccacacatctaaatatctgatttatgatcaaatcacccatttttatttttccttttgtagcttctcaaatcttttgtccttaatcgatttaaaa

SEQ ID NO: 37885 - DNA, 480 bp, Neisseria meningitidis
cagtcaggttactaataaactttcattatcccttctttgttatattactaatagaccaaaaacatttcagatactcagtgccgatgtagagcctaagaagaagctaaagcacattgtcatggcggctacaaggtgagtctaaaaaacaagtgttctctttaatgattcttcccaaaatgattgtttgttccttggttaatatatagggaacagaggtttgagagggtgactaaaaatctaaaagtggcaagagtgtttaacacattggtagaggaaatgaaagcaatggggatcgcatctgttgatgactcagagtgtacagaagttatggctccagttgcacacaaggaccgaagcccggttctacttcttatgggaggtggtatgggtgcaggaaagagcactgtgcttaaagacattctcaaagagtaagtaaagtatcaacatatctgtcattaatcagtgttcttatgcattgaa

SEQ ID NO: 37886 - DNA, 454 bp, Neisseria meningitidis
atataagagttaatcttataaatagttttctgaaacttaatatactataacaatgtaaaagtcgtcgctttgttatttgaagtgaaaattaagcaatgttatgatatttttactaattaactcaatatgaaaaacaaaaatcctcttaactaaaacagaaacataaaagacgacttagtttttgctttagatctagactcataactcaaaaaacaatttcattataaacttttgtagatcttacaattttaaaataaaatgtacattaatgttgaaaagcaaaatcttaaattagtgtatactactactttttttttatcaccgtgatagatcattagatccttaacctcaatccctagagcctgcttattgcctttaagcattgtgcaatcactaccaaacacactcaaaactaaataaatataatttataacttatcaaataaaataaatac

SEQ ID NO: 37887 - DNA, 842 bp, Neisseria meningitidis
cctcgaatttgttttattttttcattaatcagaccagacacagttgggataaaatgaaaggggcttgaggagtgaggacggagaaccacacgtgtccacacagttgtgataatttttttattcaacaataaaattgcaagagacgagtttggtaagtaaatccggttgaaccggtccgaccggtattgaccgaaacatacaatcttttatagtcttcacacattgttcccaactttaaacttagaaaccttagatgttgtattcaataattgtcaaaccacaagtactgacagatacagatttaaaacatttttgttttgatcaatttaactagatctgttcattcacctgaaaacaagtctctacagagttctccataaaatcttgagacaagttcaatgaagacaggactcttaagattcttccaacagaagagaagttcctctatgtccattaagtcatctattttcccttcttcaacaatcagatgaatcagatagttttcaaagcttctacaagcatcttccacagcattgtcttcaaatgtatctcttgcgttcagcgatttcctggtccgtgaagagtaaggtgtcgtgatgggtgaagtgaagagcttcttggctgttgctggcgtaagaggtgattgcataaacttggagtaatcatcatcgttcacactaactgcaatggcaaaataagagaacaaagagatcaagaagctgataaaatttcaatgttaaaacagattttgtagcgaagttgtcttacaagaggaacttctatgtttggcgttgctcatcttaaggttcttgcttgaattgaggaaacagagacaagaacag

SEQ ID NO: 37888 - DNA, 1000 bp, Neisseria meningitidis
ccagtgatcttatttcattatggtgaaagttggaacctctcacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggargcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgtcaaacagagaagctggctgttatccactgagaagcgaacgaracagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcgaattatgtcagcaatggacagaacaacctaatgaacacagaaccatgatgtggtctgtccttttacagccagtagtgctcgccgcagtcgagcgacagggcgaactcgmagtgagcgaggaagcaccagggaacagcacttatatattctgcttacacacgatgcctgaaaaaacttcccttggggtatccacttatccacg

SEQ ID NO: 37889 - DNA, 467 bp, Neisseria meningitidis
cagtagaggccataccaattatcggccttgctataatggatttggtggaaggagtccgataatctaacttgcatctaataaattcaaacttggcagcgagccaacttgcattgaacctcaaacattatgctattcattctttacttaaacttttgatctgagaaattgtttgtttttatgtaagttggtcgcctttattacaaaagattttgttcttacttgatagttactatctattgaaatgaaacaagttcttatatcacttttatgcagtttgtaggaaatgcatttatgagaaaatcacagaggatgagatagagagctgtccagtatgcgatattgacctcggggggtacccaactggagaaactaaggtaagttcttcttcttctttattccttacacaattttctcctcggtcttggtttagcagtgattccttgtatagactgttagaagccttttgg

SEQ ID NO: 37890 - DNA, 1343 bp, Neisseria meningitidis
taattggaaacgcggccaagaaagtgaacacgctttctctacacgtctttaactccacagctacttatgactcacctgcttattttaatctcctcaaaagtctttcctttttttacaattttttccaaagactcaataattgtggtatgatatggaagagagcattaatggcgtatcttcaacgcccaagattttgcatgtggctctatcgtgattcgagttttgatccatctctctaggtatagaaagagaaagagatcaaaccaacctttaacaaacttatggacgtaactatatcacttacaagccaagtcaatgatgaagaaaacatagactgatgatgtgaagaaaaaaaaaaggtagataacttgtgggattcttgatgttaagtttagagaaacaaagttgagtcacttctctctttctatgtattcatcaatctacaacgagtaaattagcaacaacaaaaaggaacagaacaaaacaaagatcagagggtctttgtgtatcaatagctctcattgttttcattcggaaaagattcgaacatcgcacgctggtttgagaccatttatcacatcactctgcttcacactctcgcacgcaataacaattggtatatgaaccttaaatcccaaccaatcaacactcagtttccctctcaagaacacatcaaccaaagcttcaagcgtcttctctttgtttgtcagcaatgtagcatcaacatcatacactttggattttctgagtcttgtgaggatcttcaaggaggtaacatttcccgggtcctgcttgaatccagaaagtgtcttctttccgaggtttatgttctcagaagatatatcagctttcataggactgtaatatagcaccgtcttgtcattattattagagagctgaagcaccgtgttcaagttcgcattcatcagaagatctgtcgatgatttggcgatatccaatctcgagaacttgaggtttgtgacaagcacctgaggtagtatagatttgattgaagagtttgcagacaatcctaccaacaagacgattataaggacaacagaaacaaacatgcaggtgcaagcgcagcattttctgaaacatccagaggcgcatattctcttgtcctcctgaccgatatgatccacaaaggaacccgattttctactccgatcggcctcttcttcctctcgaaagccagacagtctcgacgcagaaggaggccgcttaaaagacgaagcctttttcgggttttcaacatcatcaaacctgtttcgagaaatggaagggcttgagaatcttgaactcagatcaaaagaacctttgccatagctactatcttccgg

SEQ ID NO: 37891 - DNA, 1934 bp, Neisseria meningitidis
tatttttcccccataatttaattcatgaaactgacttggatagtccgaaccactagattagattcgcatcatacaagtacaactggattataaaactgaaatagaaattcaactataaaattcaaagcacgtaatgaacttcttcttttttcacctattgtgtttccatataattccacaaatgacattttttaactggtagtgaggataataggatatgatgattctcaaatttcgaatatttgtatattggttgttaaaaacattcggataagtcacaaacatataaatcagcataaccttggaaaaaaattacgtttgaaatctagactaatacatccaatccaatgattagtttgaactacatgcataattgcatactaaataatgatcaagtatactaaattctggagtttgatatgattaagcgmaksttaatgtttcggccatgtgaaacctcgtcttagaatagttgtcatcacgcgatgttggctaacgtaacaagaatcatcaatctcgtaccacacatgttgcacatgagaaacaaacagccgcaatattcttgattcacctttcttcttttctcttttaaccaaaaacataagctgcaatattcttaattcacactcgggaccaaaacatgttaaagagttattgttttgtcattggtattcaaactcgtgatcttgaagattttttttttctctggtcacaacatcataatcatgttattttctaatatttatgtatacttagaaataaataatatagttaggatattttttaagtaattaattaacatgcaaaggattttgtaggacggcatgtaagaaacagaatcaactgatagaaactgcaataatgcctgatacacacacacagctgtaattggggctcacgttcccagcttgcaatagacatttttttgtttatcttattcataaaatatataattacaatactaatatcatggcatctcattacccctcatataattaaagtataaaaaaacaataaagtataccacatttctaaaagaaaagtacgcattatgaactttattaactcaaatatcgagtatcagagtaaaaatatgtcatatataagccatataggcttttgtgaaaatcaacggcatgtgttaatgttacaggaatgaatttggaatctttaaaagggaaaaaaaacaaaaaatgaaactcactatgcaaaaaaccatgtctacctaaatttggtcacaaacatgttttacgtgattatatttgccttcatgaagtatagaccaacaagaacgtctcaaatagtaaagacagaacgtgggtaagtgacaaacacggttgcatgtaaaaggtaggtacaaacgctatatcgacaaccagatatggttggtgtttatatctgtgtaacctagtggtgcatgctcaatgaaagatataaccaaaaataacacttttttccttatgcttaagaaacatatcagatttggtgataacttgaactaaagacccaagatatggatatgaatttcttacctaagtttttaaagagtcaagaagcaatgccttgttaaaacaaacgagctgaagtgtgcgtctttccagcattatcatttgttggaacgggtctctacttgtcttttctcctgattctgtctcaagattcatatgttagctttttgtaataattctaggtaataaacaaattatcttagcaaacagaattaaatttacctctgtttctttggtgacgagcttccatgacctccttgttggggttacatctaacaacacttaagaaatttttatgtgtcagtgtaacatattgtaagagatgttagtgaagaacacaaagaagtgtgtgacaatgttcaccgtacatactcattttcgtctgagaggctctttgcaatggatgatgaggtctcatctccctgg

SEQ ID NO: 37892 - DNA, 1492 bp, ONeisseria meningitidis
ccctgcctttgcgaaacttggataatcgatattcctttttaaaagatgtgatcttcgagttggtgaatctgaaatacagaaaaaccaaggaattagcaaataaataggcaaaaccccagtaattccaacaaatatgtagataaatcacaaatatttctccaacttcaaacaccaacaacagaggaaactaagagatactgaaagaaagtgaactaaaacttaagagatatgatttagaacttccaaaagaatgatatgaaacactgagtcaatgaacctccaaaagacatacgcttagactataattattttatgaatacaactaacaaggtcaaatgaaaattctttgataaaagcatatatgcgtgttagctgttattcctaatttagttgagataaacccacctctaatgttggacctccaggtcgtttccaggtaatccctaaaacgcagaagacttttaatgtcaaaaggcacagtatcaccatcataaagtgacgaaataagagagtttgaagactacctcttctttttcctatggtgttctgtagaagagcgactctcagtgcaatcattgcaatatttcaggaaatcagggttcaaactctccttttggcatggctgttcggccttccagtaaaaactatcttccccgtcatcaagaaaggcgggcttagctggttaaggaaggacaagaaatcaaattcatacatctttttacttgatctcgtgaggaaagaaagaaacaggtgcacatatcttatatcagaaaagattccctatagttcatatcacaccacatgaaattgtgtaatattcactaagaagtgacatgctactttgatcaagtcatgttttccataaatttcagaaggtagtgggttgcatagatggtgatttgtgaatgaaaagaaaataaaccttttgcataagacattaccattccattcatcgtcagagaacctgctgttgttgaaatctgcaacgtcacagaagtaatttctagagtcgctatattgtttgtgcaagtgatcactgaaagtttgcagtttttgctttctgcccccatctttagcatgtatgccaattggagacctataaaggctgtcatcttggaacattttgctactttgaatcattgtgtcctgtaagagggagatgaaaatatccggtcaggaaaaaagagttagaaatgaatggaagacagctaaaagataagatgacgagactttgttaccacttcgttctcaaagtcgttgagccttcccctgacatgtgatgtatctggttgaccagtatccttccatggagaggagcaccggtacacaaaagttctttcacatcacaagttaaataaaatcactgatctatatcttaagtggtacatattactgctaatgtaagagaaaacagtataaataaataaaaaggaaaacaaacaaaatgcaaacaagtcccaagaaaaaaaaatactcgtgaatgctaatcacc

SEQ ID NO: 37893 - DNA, 339 bp, Neisseria meningitidis
ccatacatccagttccacacaaaactgagtggaaaacaacagaaacctgaccggaagaaagtggtgaggatggtgaagagattgttatcagaccacctagggatttaagacaaccaccacggccaaagaagaggagaagtcaaggagaggaccgtggacgtcaaaagcgggttgttcgatgtagccggtgtaatcaggctggccatttcagaacaacttgcacagctcctatatgaaaaacatatgacatctctctttagatgttttacttcttctctgatctgaatttattatttcttatacttaggtttagaatattattttcaaagcctttctctg

SEQ ID NO: 37894 - DNA, 746 bp, Neisseria meningitidis
ttgcataaaataatatgactaattcgtgaaaagacaggtcttcccgcctcttcgaccttattgacctcatcaaccatctacttgaaaatttactctattataaatatccgtcctctcacctctcacttttaaacaaaacttaagttttcttaaagagtcactaagaacttctaagatttcaaagaatggaaggaaaaggtggtagcggtggaggagggaaaggtggtggtggaggaggaggaataagcggcggtggagcaggagggaaaagtggttgtggtggagggaaaagtggtggtggtggtggaggagggaaaaatggtggtggttgtggaggaggaggaggagggaamggagggaagagtggtggcggtagtggaggaggtggctacatggtagcgccggggagcaacggatcttctaccatttcaagagataagtttgagagtgatactaaaggttactttgataatctccatggtaaaaagtgagtttggtctttattgatcatctatggagaatggagtgaagatggtttactaccaaatatattatgtaatgaatgaataaatgataatttgctttattgtcttaccccatgttaactatatgtgtattcatcaagagactctaaaacttgtgtaataatcagtgattgaaatgtaaatgtaagattaatttatcaatttggttctcactgaccattatggatgggcttttgaatacatccatttcaattgtttggt

SEQ ID NO: 37895 - DNA, 474 bp, Neisseria meningitidis
ccaattgcgtttcaaaaaattgcaggcagtgggacaatggatgcaagatagggtgtgtgtgtgtgtgtgtgtgtgtgtgtgtgtgtgtgtgtgtgtagaaggtacaaaaggaaaataaatcttgtggcccccaaatcactaaaccaagggaaaaatcaggctggaaactgtcaggcaaacctgcctcccattttattcctaaataagatagctagaaatataaaagagctacatacctcccttacaatttgtccacaaggaaattccttgtgggcctcaagatctttatcctaagacatttctgttgaatttcaccctggcaatgtaaattgatggctgatcttcccaggtgcaggacagaaagtcatgcctctgcacacctaagacaaatgcatatctgattgcttcctctgccctgttgtttatgtaaaaatgcagattcactgactagattgcatattcagtgagaagctg

SEQ ID NO: 37896 - DNA, 1476 bp, Neisseria meningitidis
tatgagagcaaagcttttgttgcggttatcaccaaggacaaagacataacctttggggacaaactgcaaataaacatgaaaagcaaacattgttaacaatctgatactcaacaaggatgaacaagtggtaagtaaaagttgctcaccattggttccatttcatatgacattggttctaagacaaaatcttcttcttgcacaatgtcattcacaaagagcttcccatcacgaacctgcatggtacatcatctacaggttagacaaaaatttgattaaaaaaacagaaaaaggggttaggtccatttctgaaaaaaaaaacttgtagtccgagaaagcctctacacaaataataccgaccgaggtgaaaaaaagacttcaatgggtgaaaaagatcaatcaacaagtggattggatataagggcttacttcaacccagtcaccttcacttgccactatcctttttatgaatacatcattggaactgtagccatattccggatattcctgcaattcaaagggagaatatcatcaaattctttagtttacaaaagttgatacatctgaataacaagaacaatgaactgtgacttaccagcaaaattggaggagccttgaagattactatatctgaaacctctggcttcctgaaaaagtatgagacctgaccaacaccaaggcacacaaacggtcagtttagtcataaagagactaaaacagcctcattcacaaacctacatcaagcaactaaacaaagctcaaggtgaagtctagcaatcacctatagaaaaaccttcacattcaatcacataagagtatcatacaactatctccatcctaaaacatgcaagaactaattccagaaccgtgtagaaaaagtcaccatccatcatcagctatgttttatgattacaattatacatgaacagactcagaattcataccttctccgccataacgcgatcacccttgtccaaggtagggtacatagacgttgaaggaatcgactttggctccgcaagagctgatctaaaaaggatagaaacagtaaccgccgtgaaagcagccttagcatcctcagaacaaacactcaaaagcttattaacccatccacttcctccattcctcgattccttatcatcatcatcatcacaaactgttcctcctttatccacgtcatcaatcaccggtggattcttaatccatttcgacccttgaagaaacggaataatagaagaagccttgaaagatgaaacccccagaacattcatcgttgacgactcatgacccgtcgttgacttcaatatcgagatcaaacccatcacaagcgggctttgacttccttctccgatgagctccctcgcgatgctaccatacatcgatgcaggtcgattccgaggagatctatcgaaatcacgcttgtggggagaagaatctaggacgaaccaaggattcaaagcagtaaccaccgggaccaac

SEQ ID NO: 37897 - DNA, 633 bp, Neisseria meningitidis
cagccattaatgttaacatttctttatgtacatttctgatctttggttgtgtgttttctctcatctataggtgcgacttcaactggaaacactgttagctgagaaagcacggttggctcatgaaaactcgatatacacccgcgaaaacctctatctgagaggagtcgtcgaatatcaccagctaacaatgcaagatgtggtctactttgatgagaagactgaagaagtaacggaggtatatcccattaatgtgtcttcaatgtcttcttcatcagataactcttacaatccaaatccaagtttcttggagctcaaatgaaacaccacaacaactatcagtttctgctgttcttgttgtgaatcagacaagaagacaaatcgttgcctgtaattgctctgtatttgtagaaatatatatactctgtactctttatwtggggtggggtcttaagaattagcagtgaatgtatttattacccttaattaacttaaataaaagaagaatgttctattatttccctgaaacagtaccatgaaagctaaaagttgaactggtgagtagaaattagtcaattattaatggatattacctgaaattacagaacaaacaatatatatataaagctacattac

SEQ ID NO: 37898 - DNA, 575 bp, Neisseria meningitidis
aagccttttggctcttactgttgatgaaacgaattttcttacataatgctgaaaagttgtacatgattatgctgaggtgtgccacatatggaaggttcttccgtaatttttgtggcatagtgtgaagttaatcaagaaaagtcatttcgattcagaagcagttatgacctgaatatgttggctagtttaatactttcgctgacaccaacaattttttgttagaacctgaaacaaatctctttagtactacactctctcttactagttggtcaccagtaagagctttgttggtggcgaacttattcattttctaaagaaccactcttatgtatttattttaggcctgaccacattttgcaagacttgagagccaaattatttcctctaaaacgtaaaaaggagagagcgcctgaagttgtgtcctccatctcattacctgcaaagaggaaggagaggtctatctcgtctttggtggtaagcacacccagggtttcagcacaagctggtacaacaggaaaaagaacaaaagctgctacgagaaaagatgtaagaggtagtggttcattcactaagag

SEQ ID NO: 37899 - DNA, 384 bp, Neisseria meningitidis
ccattattgtttttctacttgtaactgttttagaaatatattgattgtaaagaaaaaattgttttttagatattatttttttaattacaaaattagtaaacctcactataaattaataattattaaaattatcgataaattaatatatttatgaatatatagaatttttcgtttctaatattattaatttgtagaggttttatcgtaattgtttttggtaaaatgatttaacctcttaattaatctccttataccatttacaagtctacttcatgcagttttcaacaactgtcataatttgtgtttaacaatattataagaaacaacttttaaaaaaattaaaccaactaggcatttggttgaaaacaattacaaaaaaaaaaa

SEQ ID NO: 37900 - DNA, 757 bp, Neisseria meningitidis
  misc_feature (720)..(720): N is any nucleotide
tacatcaactccgtgagacttttgcatttgctacttggagctctacggttacttccgttgaagcgctctgcaatgaatgaccttttgactgtttctactacacacgtttttgacgtttatcctgtttaccttttgttcttgtactacagtgatctttgaacctgaaagtgtttctcaatatatgttaaacttgattccagttagattgttttggtttttatacaagagatttggcctatggctgtggagtaatgagttatactttgttttttatgactcggtttaagaatctcttgcataaaactgacsaagcasactcttttttgacaaaaaaaagtatcacaacagagtaaaatcaagacctagacgaaaagcgaaaaatgacaaaagccacaagagttgtggtaagcaaaatgtttgggaaccgctcgaatcttttaaagcatttggacatccatgagtccggcggcaaatgatgtgtagaagggtatgtcacaatctttggagcagaatccgaatgtcgaagtggaaccatattctctacgaaatgagataaaacacgaatgtctgcagcgataaaatggacttcgtttgtttctggattatatttgaacagcctcttttcactgtcatggaagaaaagattcccttgcttagaaactgtcactggtctacaccacaacctccatatccaagggtgaagagctctagggaataaancaaatgagtacgtcttggtccatgtatcttccggata

SEQ ID NO: 37901 - DNA, 380 bp, Neisseria meningitidis
cctagaaaattttccttatagagatatatacagacagtaacaaataactttctaaattaactcttcttatcacatatataactgaaaatgtaaccaaaatacaaactggatccaactcatatatacgtcaaatgttttccaattcaaaatctaacccaacacaaattaagaacgctaaattgatctatagctaaatgtcattacacaagtaaaaagaaaccgttttgtaaagttataatcaatctgaccatagtctaatttatttcgtcacaaatattttctaaacgatgatactcttaaatgttaaaattcaatcatatatttatacccaaacaaagcggctaagtaagataggaacctttaacacaaccataaatagc

SEQ ID NO: 37902 - DNA, 1223 bp, Neisseria meningitidis
tgtgtgctcgcattacgacataaaaatgtaatttgagttttatttcatttctttgacaaaaaaaaaaaaaaaagttttatttcatttatttacccttttttatagatataaaatatgtaaatcaaacttttatatcgtacaatttaagtatatattttgtgttttattatgtcaagttcattcattaattttaaatttgatacaacaaaagaataatgtagaaagtcaagtatacaatgatggatgaatggatttacataatgcttttttggtacgtaaacgttagtatttgctaacaaagtattagttgcgttatttttttcagaacaatcaatcctaattttaaatatttttattaaaaacactatgatacatattaatttacattataatttgttattgaaaataaaaacggagcaattttgtcataggttttttttttgtcaaccacacaaaaatggtttacaaattacaatgtaactttaaaaaatggtatacaactacactaacaaccataggtcacaagaaaccacacttgctattttttctagatccaaatttcacaatttaaaaccacacaaattttctagaaggaatcaatatttggaatgccatttaataaaactttaactgttatttttaaatatattgaatttaaaacgaactttgaatgtttgtgtagttttagacgaacaactaatttgtcaagttagctaggtgatcaagatagaaaaaagttcgtgtgaatcatattttgttcatgaaaatttggtgtagtttatggttatgaggttatctcatatctatgtataaaattagaatgtagaattttgtctgacatacttgtttaaaacttaaaattatgatacatatatcacctattctttttaattcttaactttataatccaaaactgcaagatcatttaggcccattgatttgaatatttgttgcttatgttcactcagaagtcagaaaccataccatatcacatgtcttttgctgaaactcataagccaactgtggtaggggaggaatttgcaacagtggtcctctctcttctcagagttcattcttcccttcttcacagaaaaaaaaaaacccttaaggattaaatctcatcactgtttctttcttctttaatcacatctcagttttatgtgtcagtggtcctctctctaccttcaacgattatccaatgttcttcatgcatatatataaac

SEQ ID NO: 37903 - DNA, 659 bp, Neisseria meningitidis
actagatacctcgaatagttcctgtggaatcaaaccagaattagtagacacataatcttaccaaatgtgaaacaagggtgctaataagggccttgttacagatcacgatcgaaacagaggacacaacggataaactcaaagcgccgattgttccaagctggaacttctgggcatcgctcatatttgctcgcttcttctatcacgatctacgatgatctaataaaaccaacaattacagtatggaggaatcaaactcacatcacatgcttagccaatcaaaaccaaaagtaactgtaagagcaacgcgragaagaaaaaaggaacctcatttacgaaaatgcgagagaattcaaagcaggagaagctgaactgcaccaatggaagataataacaacacgtcaaattacaagcagaacaaggatagtgtaaagtcgaagaatcctgaagcaataaaccctagatctatcgatgaagataaaaaatagtttaacggagattcaggagaagaaaaggagagaaaatggagagagagaccttgagagaatcagacaagttctaatggaggagaagagaatctgtgaatttggaagaagaagcctatttttgtaaattccaagagattcaccatacgtcaaaattgggcctatatgtaattaata

SEQ ID NO: 37904 - DNA, 767 bp, Neisseria meningitidis
ccatctctcaaactcttcaacgagcttaatgaagagagaatcagcaccaggctcttcagagaagaagctgtatatgtcttcctcacagctgcctgattttcttatgtactcattagctaatttgcagagatgaggacattctctcctgtccttgaatcccatctgccgcactacaaaagacacaaacaacatttccttaatatgcatcataatctaagatcaggaagatttcaaggaagctatgtagattgattttaccaacatagtgagagaatctctcaagcttctcatggcctttgtgtttttgagacgatctgagacgagggatgttcttggagtgacgtagcttccttagacggaagtgcagtgcaagggctaagagtaagccaatggatgagattactaaaatctgtgcgaaggtcgtcgtgttgttgttgctgttaaactctggaacacacattgatctggatttgctttggggatcatcaagagacatgagattaagattgttagaactctaagattgggtccattcttgagtttgttttctgttacgagacaatgtatctgctttctccacgtgtgttgtactaaaatagctttgagtcctattactccggaagtttcttagtttgctttttgtgtgatttgactcaccattttgttttaataaccaaactctcatccccaatgtatgatataatagtgttttggcaatggttttataaaatctattcgttaaggctataacataacaagaatctgtc

SEQ ID NO: 37905 - DNA, 453 bp, Neisseria meningitidis
  misc_feature (407)..(407): N is any nucleotide
cctgcaagcagagacgtctagaggattgattacgtatcctacaagtaagaaatagaagttaccggcgacattgatgttctcgacgatgtaaagaacattgtcctcgttgatttctcccttctgctcagcttcaaggatgtgatcaatggcacatttcaatccttcactacctgtaggcttagaactcgcaatttgcctgtaagaatgaatcatcaatgtcaatttcccaaaatcaaactcaaaagataaaactaaaaatagaaacaaaaaaatgaactcacttcctctcatcaacaaagtacttcttgaaaagagcgattcttcgatctttcacatcttgacaaatcttcaaatagcctctgaggaatggtctaaggataggaatgaaatctccatagttatactcnaagctctgagctaatcgacttctctcaccattcaaagccttaagcc

SEQ ID NO: 37906 - DNA, 1208 bp, Neisseria meningitidis
cttctgttttatatgaggtatccactcggtctaatatggaaacacatagaccgtagttctatacattggttcaagtcttgtgcttatcaatatgactgtaaggtccccataaatgtttaaactaaagttaactctcccttttatttccgacttgtgtaccgggtgatatcttatgatctgggactttttcgacccaccggtgttgaaccttaactactctatgttttttttttgtaaacaggtagagataacatgtatgggagaaccagtgatcccaacgttgcagcttcacagcttagtagacctatggttggaaacaacttctaagcatcaaagagtcgctgcgtcaataggttcatctgcaaaggaatttgtaatggtgctagtttattctcggaagctccctgaatgcaacaactaaagagctattcattgaatcttttctagaccgagaagaaagaaaagtgcaggagcagtggaatgtcttgtgtagaaagaaacttagcaatttatatttatttaattgtaatcttaaaatttgaaacattggtgtgagacagacactttgtttgtttatccaagaagattcaaaaatggctttttaaaggagattgtgtcctttttggatatttgaatgtatgattaggataatgttgtcatttctataaatatttgtttccttgtttggactaaatggagaagtacacggaatccttgtgaatcgaatgacttagccattattgagaagtcaaaagaaaaataaccaaaaaaaaacttgtgaagtgtacctttaatacaagaattaaagagagatgtataaaagttttctaacaattttgttcaccaaaaaaaaaagttttctaacaatttttaatacaaaatgcaaaattaaagatgaattttcttatttctttttttaaaacataattttgaagaaatttggttgtctttttgcatttgtttctagatatttctaaactgttgggaaataaaaaaatttgcacacaaaacatagttaaattcacgtggtatttatagagatttacttcaaccaaatttggattttgggtcattgttttatggacggataaactatccattagtcaaatttccacaaaaataatatgtgaattagattcgacaaggctaattcccccacaacatacgatactagaacaaacgtctctgactacttgacgtaacaatgt

SEQ ID NO: 37907 - DNA, 568 bp, Neisseria meningitidis
tcttttagtttgagattagttgtgcaatcaaaggaaaggaaacttcttggcgagtagagagaaatggtgattggtgaaggtgaaactcttttttctcaattttaaaattcatttttgttatttttagcagaaagtcaaacatttgaccgaaaaggaagaagaaggagataagtcaaatccggctgctgggcttattgggtcacacgatcatgtcgtttcatttgttatgcttgacgaacgaaaccactatattttgtttaatattactttcttttaagtaaggataaaacatgtcattgttttacaaaaaaattaactgataaacatttctggttccctgaatatactttttttttttgtgaaagggttttcttatataacttgaacataaaaagtatacaaaaaaaaacaaacaataaccagaaactagattggggaagaagaccaactaaggtacttaacaaaagaagatatcaaaacctatatatcttgataatgatggattctttttggtttgtcatgttaatgatagtttttagtgtagaacaataagaaaattgactgaaca

SEQ ID NO: 37908 - DNA, 465 bp, Neisseria meningitidis
ccgtgacttcttctgccgggatcttcacgctctcatcccagaatttcacgcccataatcgggttgacgattttgacgctggagttgaggtattccagatccttcgcttcatgcgttgcaccaagcatgttggagtctgtggagtaggctttttcgacagacattttgtagtcgaaaccgcagcaatcataaattcagacatctcatgacggccgcccagttcatcaataaagtcagtatcaagccacggtttgtaaatctgcagttcagcattggtcagcagaccataacgatagaaacgttcgatatcgtttcctttgtaggtgctaccgtcaccccagatattcacgccatcttctttcatcgcagcaaccagcatggtaccagtcacggcgcgggccagcggcgtcgtgttgaaataggtcaggccgccggtggtgttatgaaatgcgccacactgaatagc

SEQ ID NO: 37909 - DNA, 594 bp, Neisseria meningitidis
ctaaactaaagttatggtctaaaatcacactctcatttacacaatacttctattattaatgtttggttctgactacaatcaaacctttagatcaaaattgtttcttgacttcttgttgattcaccaccaaactagacttatctctatacatgttttcaaaaccactcaacaaatataagcaaacaaagatcttcttcactttgcacataaccagaatgaatttctactaaaagatgagatctgagaaagatcaaggaaggcttttttaccaagaacaggagcagagatggcgacggtaggcttgagaaggagagccggacgagcggcggagacgtggaagcggaggcagtaaagctagccatttctctatttgcttcccctaacgactgagagactcttcaattgattttttgtttgttctgtttgtgttctacagcaacaagaacacttttaatttctttgcttgtgttggcttttggatcaaacataaatatgtggtggataaaaaatctgttcgaaccaacacaagccatctaacttggatatgcttctatccatactccaccaatcgacgccctccacgtgtcatatttc

SEQ ID NO: 37910 - DNA, 358 bp, Neisseria meningitidis
cgaagctctgatgtccttctcttctatcatctcaatcattgattccctgaaatctttctttggatcaacggaccgcttcatcacagcgaagtctcctagaacatcttgtttgctctctgatcttctagaagtgcttctacgagtacctgagagttgaattctaggtgaattcactcttttgaggtttatcccagcagatggttttcttccactagaaacttgcctttggtacttcttctcggctttatattcattatcatcttcatctcttgaaattttcacagaaagatggcttttctgcggtttcttaatcggcatgcatgcagtacaagctttctctaccgaatcaatcactttg

SEQ ID NO: 37911 - DNA, 365 bp, Neisseria meningitidis
atggcatagctattcattacagatcaaattcacttcacttgttaccctgtccactaccatgcaaattatcaaagtaacctttaggatcactctcaaagttatctcttgaaatgtaagaagatctattgctccctggtgctaccatgtagccacctccgcccccaccaccaccgcttttccctcctccaccgcaaccacctttcgctcctccaccgccgacgcagcctcttcctcctccactgccaccaccaccaccaccttttcctcctccaccgctacagctaacgccttttcctcccattctttgaaatagtagttcttagtttcactctctagaaatttttaagattttgtgtgaatgagaa

SEQ ID NO: 37912 - DNA, 518 bp, Neisseria meningitidis
acaactcttcactatactatcgccatatccatcaatctaacatccctgagaccaaaattagaaagcgaattgaagaaaccgcagaagtagaagaagctcaccgacggaagtgatgctcttgagccgattcgaaacgaaaacaatcggagctaaaacagataacaatagcagcgagaggatcagaatcctctgccaacgacgaacttgattcatcaatgtgcgtaacttctcagagaacgcttcatatattttatctccgttgcgctttaatcgttctccacgaagaagaagaagcacattcccagagggaagaacacagatctcggagattctctgcttcttcaacaagcaattgaagaaaacgatgagcagattagggttttcagattcttctgcaataggattcgataaatgcgagagtctgtttctacgatttcatatctggagattcagagcttcctcgtgcatgtttagagacttctgctcttttattttttttcgcttaactcagaattttt

SEQ ID NO: 37913 - DNA, 704 bp, Neisseria meningitidis
ttaaagaatgtcttttattagtatcatcatcattcatcatcaacatcaacttgagacatcacatttacacgcttgtgctcacataattaataaatttattttatggtgaatttttaaaattggttgactaattgaaattgtatttggtgaaaaactgaaaatcataagaacataacttttatctaaaatattatataattaagggaatagtacaaaaataattataaaacagagaatcagttgcttctgatttctgacagatttctatcatcatttcatggagattttactcttcatcgaaatgataaaataactgaaaaatgtaattagcgaattataaaacagtagcaaatgtaaacagttttaaagaatacacaaaaaggttgaccaaatggcaattacaaaagaaaaatacagcttcttttcctcgaagtatgctttttgattgaaaatattaaaacgtttctaaacggacaaatcaatttaataaataaaaacaaagttttcacaattcaactaaaagtttaacatatgtgaatctatctaggttaaagactcaaagtacacgttataatgragttcaatagtttcatttcgatgcttctttgaatttggtaaagtgtgaaccttatcttaagtttttaggtagaaataatttagtatagtagcactttatgttaaattaaggtgatacagatacacaa

SEQ ID NO: 37914 - DNA, 473 bp, Neisseria meningitidis
gaaaatatcaagatgctggcgtaacagcatttctggtggagaaacgtggtcgaaactcatatagcgcacggattcaacggtcgctttcaggttctcaatggtatcccacgccagttgacagtcggcaatctgcgtcaggagttgatggaagttgtcatcaagttcaaaaaaatcatccagttgcttgcgctcaatggcaatgcgttgctggtgaagattttgttccagttgatagcactggctttcggtaatcatgctcgccgcccgacgcgccaccgcgcactcaatggcctgacggataaaactgccgttgcgcacctgggccatggaaattttgttgacgtagctgccacgttgcggacgaatttgaatcaggccgttttccgccagtttaataaaggcttcacgaaccggctggcgtgacacattgaaacgaacagaaacttctttttccgacaacggtgtgcctggag

SEQ ID NO: 37915 - DNA, 408 bp, Neisseria meningitidis
ccgtggacagatcctgactctcacgacatccgaattttcagaacaaggtaaaaatgatcttggatagaagcttgaatcacggcaaacagttttatccctcacacacaaacaaaaatatttaattgttaaagcacatattttcacacatattataatacaattaggtcaagaatttaatttttctatttggaactagatcaatatataaacagaagaagaaaaatgttacgtgcctgtcgccaacaagtctgtacattctaaagatgagatcttcttcttgttcggtcatattgataaactcccatttcatactactcacttctgcattttagttagtatataaattcaaaatatcagtgaaaacgtacatcacaaaacaatttaatgttacaggtcaaatgaatgagc

SEQ ID NO: 37916 - DNA, 931 bp, Neisseria meningitidis
caagacttctttcttctctgcgttgagcttgtttatgtaggtatcagcgtctctctgagccaactcgagctcatgttgtaagctcttcagcttctcctcagcggctttgccgatctcgagctcatttttcagagaataagtctctttctcaaagtgctgaagcttctctttcgcgatactcagctcttcctccaaggctagcacttttgtagctactgcatcttctttagtgtcctctttatccaaatcaacactcttttgttcagcaccaagatgatcctctgtgtcaaaagacatgaagctctgaagctgattcttcagattagcaatctcgtcttcgtgcattcgcatcttctcattagcttctttaagctctccctcatatgtagtaattttgtgaaggagatcaacattgttgtcaccatcaacactttcctgctggagaaggagcttctgtttcgtctcttgaagctcaagctcaagttcagccattctacggatcaatgcctcgtcaccgtcttcatcattggcagaggaatgatcagaatcagaaccagaatctgtcaaagacgatgaatcttcctcttctttatggctagattgacggcgactcaacttctctttggtaggagatgatatctcaagagagctctgtgactggatctcagatgtatggttcttctgaagttcaccactagcttgatcataacgctcagccaatgcgcgatacatgcggtagaattcctcgacaagctggattaactcgggacgtttctgaaaatacatctgagctttctttgcaaaagagtctgcgtcttcttcaatcagttttaacatgtggttcacgcgatcatccatctctgagaaaccaaaacaagaacaagagagaaaacatcagattgtgttctttttgagtaagtggagagctcaa

SEQ ID NO: 37917 - DNA, 460 bp, Neisseria meningitidis
tccaccagctcaaagacgtgagtaaacactctaaacccaaaaacaaagcttcttcttcttcctcaaacacttgtagcaagaagaaaccttcctcagattctcttcctcaacactcttatttctccaacagcttagtagctaacaatcctcctcaccataactcaccaagaaactctcttcacacaaaaaagatgagtaaaagaaagacactttacaagccatcccttaaacctttgactcctcctcctcttcttgtatctgcaagtttcaacaagagcaagatcaacgatcaagattcgtcttacagcttgttcccggctattgaaacctcccctgagtcttttgtgtatagtttctacgaagaggatgatgatgatgagttcgttgaattttccaacttcaagatcaacacaaagaacaaagctttcaccaagcagaaggtcaaagtgattgattcggt

SEQ ID NO: 37918 - DNA, 405 bp, Neisseria meningitidis
ccaataggtccaagtaatttgcggaaaagttagtgggctttaaatataaaacatgactgaaattgggccgtattcgacatttagttgtattattctctaaatattcagaactctcaataaaatcactctctggcgactcaacgttggccagagaatcggagagggacattaactgctggcagactggcagagtggcagtaaccatacgccgaaagagatattctcaacttgtcccgtaaatcaacatctttacgagaccttcatgcaccttcggttctttcattgtttctgggtggttggtgtggcaaatagctagctgtacgtttgaggttgccaagaactccaaaactcagacagtacgtgagtctcaaaaagtttttcctcagctagttggagatttttagc

SEQ ID NO: 37919 - DNA, 224 bp, Neisseria meningitidis
catattcagatattttatccagttgtatcaagagcaagtccactggtccagtagtcctcattacggtagcttgggacctccttttctatatctctctctttactcttcgtcacaagttttctatatagttttctctacctcacatctacttttttttcattgcattctccaactccaaaatcatcagttgtaaataatttgtccccttccacttccaaatacca

SEQ ID NO: 37920 - DNA, 478 bp, Neisseria meningitidis
ccaaacacatcaatccttctcagtccaacatggtccattgctctgcttctaatatactgcaaaagccatcaagacctgctatttcaactcctcctgtggctagtaaatccgctcaggcgcggattggaaggcctcctgtcgaagggcgagggagaggccacttgcttccgcggtattggccaaaatatacggataaagaggttcagcagatctctggaaagtatcctttatttgcttctagtacttttgccaaatattttattctggacagacttctggtgactcattgtttatcttaacaaattctagtttgaatttgaacattgtacctctctttgagaaaactcttagtgccagtgatgctggtcgcattggtcgtctagttcttccaaaagcctgtgcagaggtaaatttcccattccttaggtgatgtcttttcttgtccttgaaatattttgtagagttagtactgatgtct

SEQ ID NO: 37921 - DNA, 379 bp, ONeisseria meningitidis
cctttttgtcacataattaattttatatttataaagagtatataaataacatatgatttggatactattggtggattattttgaggattttcaattgtacacctctagaaatacaaataaaataaaaatacattttggtcgtagattgtacaagcattgatttttcgatacaaattttgtcatcaatatcttcaagattttccgcggacagtcccgagacatgcgtttaacatgtgagtgacacatcttaacatgcgtttcaagattctagctctggatcttcacactgaacagtttcgtgatgtcccaacaccgcccacaccccgggaaccgagcgagctagttaaccttgaagatcgtctagccttggttaaaacat

SEQ ID NO: 37922 - DNA, 786 bp, ONeisseria meningitidis
accacagtagaagcctaaagcatttgtccagatatcaaattcaggagtataaaggaactgaaccacaacatgttgaaagaaagagaataaaggtgaaacatttacctttgatgaggagattgtagagttaacaacaaccgaagaggccaaaacattgtcagagaagactacgtaatggtagagatcaggatcattataactttgttgcaaaagctgccttttttcgtgatccagggtaaaatattctgttgtcaaccgcattgagagacaatgaagcccttttggggtagtccttgctgcaagctgcattaaatatgctgcttgtttcttctgcgcccgagcttgttcttcggttttataagtcatggcttggagtttggtagcaatggcagggcagttgtgaaaggcacggctgaccttgtataacgcaacttccatggccttcaatctgttaggagagctgaaaagaaacaaaacatttatgtatgactcgtctaaattaacacaatattcattaagatttagcttcataagtaaaggccaaaactttttacaggatggaacaggactccctttgaatcaatcagctgtgctcacctctttggcaaatatttatcgcttggtagtatcaccagtagcccgttccagctctttcgttcgaactctcaactcgcttacgatttgggagttattcccaggtagggccaaattcagataggctttcgcttggataattttgtctctgatctcgcttaccctgtcatctgttgctctgtcaagttgaac

SEQ ID NO: 37923 - DNA, 396 bp, Neisseria meningitidis
gggacaattgtgactatcccaccaccatgaatgtgatttcttagtcatagacctcttaaactgcttcttgctctgagcctgagagaacatcagacaaagtgactaaatgttaggaccaagagactaaacacaaggatctaatgaacttatatagtgaagatcacgaaggtttcataccgtagacgaagccatgaccgtggagtgcagagaaaaaaaccctacaagaaaaagatcaagaacttaagtcatttgacaaacaaaaggcaatttgatgttcaaagactatgactttctcggatgtgcttgagttgaacaaaactaaagaaacaaattagatgagataagaggagaaaagaggacacgtgaagattcaacaacccatttgtactttgtcac

SEQ ID NO: 37924 - DNA, 546 bp, Neisseria meningitidis
cccaaaacaatgagcaccactaattattattgcaatcgtagaacgaaccatttaaagacattttacacaaaaacatctcacaaaagcaaaacaagggaatatttcaacagatttcacaaacatttataaagtcatcttcatccttttttttgtgcagaaagtttaacagttccttggtttcataacgattatggagtggttaaggatgtgcaagctgaattgtccacctttctcactagtatccactttagactgtcctggaggaggaagaagctcgaagttctggaccatcctaccaatggtgatccccaaaataggcaatgccaatataatcccgggacagcttcgacgtccaacaccaaatggcacatacctgaagtcattaccgttagcttccacgtgcgattcttcttcaaagaacctctctggtctaaactcttcaggcttcttccagctgttggggttgtttgctagccaccaagcattaacaaggattttgctttctgctgggatawcgtagccagcgagcttcgcatcaggaggttc

SEQ ID NO: 37925 - DNA, 585 bp, Neisseria meningitidis
catacagaaggaaaggacgaataattgttttggaatttgcatgcatttgaattcgagtactcataatcttctaagcgaaaacttgcgaaaactttatcacctataaaacattgaaaatattgaaaccaaatgggtggtctaatagttttgaaaactaatgtgtgggtcaaagtcactagtttaatacttgagaggaataatttatgctctaaataatcaaccacaaaattttcgatctttcactcactcacagaaaggaaaacaattcattgctaaagcgtcatgactcacgttgcttgaatccttaaattttttttgttgttgtatggaaacatccaaaatctaacatggtttatgaattaagtcgcaactgattcattttattatgttttcagtactataacgtgttacatttaagtgaaggacatcacatatataagtatacacaacaagttatctaatccaactagtccaagaagtttttatttaatcaacaaaagaagcaaggcttaacatcgagttcctcgactaagtctgtaaaatccgctcaaatcggaagtagacacaatcacacaatggtttttt

SEQ ID NO: 37926 - DNA, 536 bp, Neisseria meningitidis
taattcttcttcccaaagtttcttggttccatacttccattagtttgtcaaacgattttcaggtcaaaggcctaatgatccattttatttcatttgcagtcgaaaaatccagttttcattagtcatccttctccttggtgttggaattgcaaccgtaacagatctccagcttaatatgctgggttctgtcttgtcgctactggctgttatcacaacttgtgttgcccaaattgtatcctatgcttatattctctttcccctttccatatgtcttctattagccagtggttcagctaaatagtagtctttgttggagtcgttgctgttatcttaaccagttatatacagatgaccaatacgatccagaagaaatataaggtttcatccacccaacttctgttatcagtcttgcccatatcaagcaatcacactttttgttactggcccatttttagatggtctcttaaccaaccagaacgtgtttgctttcaaatacacgtctcaagttgtggtgagaatgaagcaatatatgtgga

SEQ ID NO: 37927 - DNA, 106 bp, Neisseria meningitidis
gatatatttctctggttaagaatttgaatggttgacaaagaaacggtcactctatatacttagaaaatatagtcatacatagacaccatcggtctagttataataa

SEQ ID NO: 37928 - DNA, 569 bp, Neisseria meningitidis
atattgcttcctcttgcaatcataatgtaatacattgctaaatgtagaaaaatatctacaaacaaacaccacagcgattccaatactagatattggtgacttcttgagtatcataacttgtttcccatatatcaatttaacattttagcattcaaaattagttatgaagtttcaattattcttgctggagataaattttatttactaggcataaatcaatcacaacgtgatatgtgcatgcttagttaatagagtatctatcgaaaattcgctttttttaattaaagtaacgtatatcatcatcattattaagcgacaaacgaatttagacattttaccatcatttacaagataattggtgatagacgaatcatacgttactttatagatagtataaaataaaattacgccaactcgtctattgcgcttgttttagtaacatatgttagatgaattggccacgttgaatctaattcatgtgtgctttttgtagaaaatcgacaagtagataatttattcgtcacaatgacccaagattcaaacctaattgaaataaaaccctagtagta

SEQ ID NO: 37929 - DNA, 451 bp, Neisseria meningitidis
tataagtactcaaatataaactcgagacgacaaaaaaagttatgcacaaagagtattattgattgtatatgttttaaagtttttcattgtctaccatgtactatatggtgattccttttttgtatttaattataatgtatgtactacatcttctttattggtacattgattatttctcaaaagcaaagttcaaaatttttagatgcacgttcaataaagttacattagtattttgaattaaggttgtttaaagggttttcaaaacaaaaaaaaaaacacgtatgccgaatttcgttggtctatcatatggagaaaagatcttcaattcggatagaccaacccgccaatagttttgaacattttgcaaaacattgccgattgttttggactttgggtttgataaaggaaattccaattacgacaaaaaaaaaaaaaggaaattccaattacg

SEQ ID NO: 37930 - DNA, 478 bp, Neisseria meningitidis
  misc_feature (1)..(478): N is any nucleotide
cccaggacattcatttcatcaatgtttaggatttggattgaagctctgccacttgggtttagtaaaaaccacattgagattgctgggtaattgagtgaatctgtcaccacatggaatactattttatccggttcctgcaagcagtaatatcatttgttaaaagacatgtggcttcagcagagattcggaaaagagcattaaaaacacaagtttggatcgggaatcttgcattaacaagtttaagatgcttgcaacatgatttaaaatgatacctgagttttgaattaacaagtgtaagatgcttgcaatatggggcataagttttgaatcatgaaaacataaaacaatgcaaggtttctcaactgtaatttaaaaaaagataaagttattcactgaacaaagagcacacaaaatgtaacttccttttcctagtttcataactagacaatatcctatatatggtactaaccacagtngn

SEQ ID NO: 37931 - DNA, 494 bp, Neisseria meningitidis
ccgcaaaccttctggtccagaaaatggtaagtatatgcttgttatgacttccagcagtcataattggagtcagtttatgaaccatttatttgctttatcgctcagaaccatgacatgtaatttcactttgcatttttcttgtttgtgtcacttgttaacggaaaaaggaatgcaagatctggatgctgatttttacagccttaaggacaacatgtccggagtaggtaaggtcgtcaaactcattatctatgaatatggtcctcttctgctcatgttgtatgtgataatgcaggaagttcatttaaccatatagcagaacctacttcctctaagaggcaagccagttttctttgtttttgctttcatataatgccactgcacaagttttctttctcagcatgtatatcatcttggttatcttgctaacagaattgcacattttcatagaaattttgatgctttactttcttacaggactttgtttagtatccctg

SEQ ID NO: 37932 - DNA, 520 bp, Neisseria meningitidis
ctcggaattccattagttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcagtatcgtattaattgatctgcatcaacttaacgtaaaaacaacttcagacaatacaaatcagcgacactgaatacggggcaacctcatgtccgagctcgcgagctcgtcgacagcgacacacttgcatcggatgcagcccggttaacgtgccggcacgcctgggtaaccagttattttgtccacataaccgagcgcaaaatgttg

SEQ ID NO: 37933 - DNA, 636 bp, Neisseria meningitidis
ttcagtaaacttcagcacgtttcatcgtcattggaaagacatctcctgtcacttatcaggttctaggacatctaaaaacatgcttagtgttagcatttgggtatcttttgctgaaagacgcattcagctggcgcaacattcttggtattcttgtcgccgtgattggaatggtgctttattcctattactgcacactcgaaacccaacagaaggccacagaaacatcaactcaattgcctcaggtaaatagtttcaccttcccttttggcacaatgtgactcaacttcatttcattatatgcgtaacgagaaaacaagagttgagaattgatgttgtgaatgtgtcttgtctcagatggatgaaaacgagaaagatccgctagttagtgcggaaaacgggagcggattgatatcagacaatggagtgcaaaagcaggatcctgtatggaattcaaacaaagattttcaagcgtagagctggagctcgatatctgaaatctgttgtagtatcagatttcataggtttccgtttgtcaactttgatatctctcttagagagaatctacagcttccctttcaaaggaaggggggagaggattagaggaggaacagctttttgttgatccatttcatatac

SEQ ID NO: 37934 - DNA, 476 bp, Neisseria meningitidis
  misc_feature (397)..(397): N is any nucleotide
cctgaatgtgcatgcaggggtccacttccaatagagaacatccttggaagatctgtgttccggtactggccaccgagcaaagtatcagacaccatataccacgaccaagctatcacaaggggacctgttgcagtttcatgacaaaagaaagttggatttttcttaggattaaagcacaagattgtgcaaaaccagtctggtcagaattgggtagacttggaattgaaactcaaaaccgttatgatatctgcagatacatactgtatcatcgttatggatcgcatctggttcttagctgatggtcgggaagccggagatgttacgtgtacaaaaggaatggaagatgcaaagaaaaggaaacgatttactgtgattgttatgtgtgaaaaccctggancagatactgtagtaaagccataaaggcaactgttaaacaaaagtgtgattttttgttgttatgagtttgtactatagat

SEQ ID NO: 37935 - DNA, 612 bp, Neisseria meningitidis
ggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgct

SEQ ID NO: 37936 - DNA, 444 bp, Neisseria meningitidis
tacataatgctgaaaagttgtacatgtatcaaattgaaaaattgatgatgcaaagttataaagcaaaaacaaagtaatgcacacttacctaatgtcgaaatctaggttcctttaactttgatacgaaatcaaatttttttcaagaatacatacttacctaaagtaaaagtagacggttcttttgaaattagatttttccgaagaaaccgaaagtatctttgtttagccattaaatcatgtagtaacatatctctatcctatcggtaatggatgaggaccaagagcgaagtaccatgtacaaaattagttcaataaacgtaaaacttcaatcaattaataatcgatgaattattattttttatatattaataattttttatgacataaatgatataaatcaataaaataattttaagaagtcatttttgaaaattctatgtaaac

SEQ ID NO: 37937 - DNA, 496 bp, Neisseria meningitidis
ttattaattctttttttgcagtcttcatatgcaaatccggaccagtccctctctaatcgaagaaacaaggatgttgatgaaccatgggattccaaattacatctttggaaacctctaaattttcttgtggatgtggcaaacggaacaaaggacccaaaatctgagcttggaaacgcatcccacaatgatgttcaggggagtaaaaccaaaacaaaggatcataaaagaaagtgtaaactcgaggaagagatcagcaataacggtgatcctacaacatcagaaactgctacacttaaacgaacgcgtcggactcgtcgcaaaaggtcatctacttttggtgattctagaattccactgttaccaggtgcagcaagcctaaaacaggagaggagaaacggtcatgtttggttctcacttgtagcgtcaagtaatcagtgagattcctgttctgtatctgagactctgagtacttctgatattcaatattttctgtgtc

SEQ ID NO: 37938 - DNA, 581 bp, Neisseria meningitidis
gtcaaccgcattgagagacaatgaagcccttttggggtagtctctgatgcaacttgtgccacatatggaaggttcttccgtaatttttgtggcatagtgtgaagttaatcaagaaaagtcatttcgattcagaagcagttatgacctgaatatgttggctagtttaatactttcgctgacaccaacaattttttgttagaacctgaaacaaatctctttagtactacactctctcttactagttggtcaccagtaagagctttgttggtggcgaacttattcattttctaaagaaccactcttatgtatttattttaggcctgaccacattttgcaagacttgagagccaaattatttcctctaaaacgtaaaaaggagagagcgcctgaagttgtgtcctccatctcattacctgcaaagaggaaggagaggtctatctcgtctttggtggtaagcacacccaaggtttcagcacaagctggtacaacaggaaaaagaacaaaagctgctacgagaaaagatgtaagaggtagtggttcattcactaagagaacagtgaagaaggaagaagaatttggag

SEQ ID NO: 37939 - DNA, 622 bp, Neisseria meningitidis
gcccattacggcagcaaaattgctttgcggaatgctgaaattgatgttcttcagaatcgggcggtcgccatacgcgaaggcgacgtctttcatttcgataaaggggggcaattgtggtgggcaaacaaagcgatgggcgttacaccgaaaaacgagcgcgtgatttccaacgtcgtcatgatgggcatgggcgagccgatggcgaacttcgacaatgtcgttaccgccttaagcatcatgctggacgaccacggctacggtttgagccgccgccgcgtaaccgtttccacttcgggtatggttccccaaatggacaggttgcgcgatgtcatgccggtggctttggcggtttccctccacgcttccaatgacgaagtccgcaaccaaatcgtaccgttgaacaaaaaatatcccttgaaagaattgatggccgcatgccaacgctatctggtcaaagcacccagggatttcatcactttcgaatacgtcatgttggacggaataaacgataaggcgcaacatgcgcgcgaactgatcgaactggtcacagatgttccctgcaagttcaatctgattccgttcaatcccttcccaaactccggatacgaacgctccagcaatg

SEQ ID NO: 37940 - DNA, 318 bp, Neisseria meningitidis
tatccatttaatgttcacttttgaaatatgtttttgctggttaaggaattttaggtgaatacatgttcagtattttaaatgtgtttcttcattgtattctggcttgtgtagtctctggtgagacgcctactatatttggtatccttgctcttttttacttattgtatctttcttatcttgctgtttttaagattttcttttcttttttcttagacagagtttcactccggtctcccaggctggagtgcaaatggcatgaccctttggctcactggctcacggccacttctgctattctgccgcctcagcctccagggt

SEQ ID NO: 37941 - DNA, 712 bp, Neisseria meningitidis
cgtcattatggatcttgaatcctcttctcggcaggttgcaattagcgagtgggtagtatcaccaacagcgcgaaatccgcgtctgataatggatatgttctgatataacgtgttagtaggcacacgcataccttcttcttcccagactctggtgaaaaaatcttgttgtgcaaccacatcaggaaaagcttcaagtagaagtgataaacatcgactggctggcgttgtcaagacgacgttaagatcggcgttatgtaccgatattaattttcggtgctcaggccagaactcgatattatcgttaataatccagtacatacgtcaataaacactaaatcaatcgaaatggagatcacatagtttgctaagtatattggtatttacggcataaatatatattaattttatatttatcatgatgattgaaatgaggctttaatgttgcaacgtaaaactttacgtaaattaacatggttaacatttatgccactattgtttgtaaattcatatttcgtaatgcttctgaatttttcgtgtgatggttttaaatactatggtgtttactcttgaggggacggcctatttataaaatacggacatttcaataaatgcccgtataaacagagtatgattctggctggtcgttgagtatcaatgttggaccgaatgtgaacgagtaaataaattcgggtattttaccacccattctctt

SEQ ID NO: 37942 - DNA, 694 bp, Neisseria meningitidis
gtaccccattctcaatagcgttgccgggcgtcacgatatggacagcctcgcggaacgattggttgaagcacaaaaccatcacttttgaagagattgctggtaaaggcaaaaatcaactgacctttaaccagattgccctcgaagaagccggacgttacgccgccgaagatgcagatgtcaccttgcagttgcatctgaaaatgtggccggatctgcaaaaacacaaagggccgttgaacgtcttcgagaatatcgaaatgccgctggtgccggtgctttcacgcattgaacgtaacggtgtgaagatcgatccgaaagtgctgcacaatcattctgaagagctcacccttcgtctggctgagctggaaaagaaagcgcatgaaattgcaggtgaggaatttaacctttcttccaccaagcagttacaaaccattctctttgaaaaacagggcattaaaccgctgaagaaaacgccgggtggcgcgccgtcaacgtcggaagaggtactggaagaactggcgctggactatccgttgccaaaagtgattctggagtatcgtggtctggcgacgtgaaatcgacctacagcgacaagctgccgctgatgatcaacccgaaaaccgggcgtgtgcatacctcttatcaccaggcagtaactgcaacgggacgtttatcgtcaaccgatcctaacctg

SEQ ID NO: 37943 - DNA, 709 bp, Neisseria meningitidis
cctgactgacggagacgaccgctttgactaatttgaattatcaacagacgcattttgtgatgagtgcgcctgatattcgccacctaccttccgataccggaattgaagtggcttttgcaggccgttccaacgcaggtaaatccagcgcgctgaacacgctgactaaccagaaaagcctggctcgtacctcaaaaaccccagggcgcacccagcttatcaacctgtttgaagtggctgacggcaagcgtctggttgacttgcctgggtacggttatgcggaagtcccggaagagatgaagcgcaaatggcagcgtgcgctcggcgaatacctcgaaaaacgtcagagcctgcaaggtctggtggtgctaatggatattcgccatccgctgaaagatttggatcagcagatgattgagtgggcggtagacagcaatatcgccgttctggtgctgctgaccaaagcggacaaactggcaagcggcgcacgtaaagcgcaattgaatatggtgcgtgaagctgtactggcgtttaacggtgatgtgcaggttgaaacgttttcttcgttgaagaaacaaggcgtggacaagctgcggcagaaactggatacctggtttagcgagatgcagcctgtagaagaaacgcaggacggcgaataattttcttgccttaatgcttgtgccggatgtggcgtatccggcccgtaaattca

SEQ ID NO: 37944 - DNA, 620 bp, Neisseria meningitidis
ccctccctagtagctaggactacaggcacacatcaccacatcaggctaatcttttaatttttttgtatgggggggggggtctcactacattgcccaggctggccttgaactcctggcctcaagcaatcctccttcctcagccttccaaaatgctaggattagaggtgtaagcgaccacacctggccagcaaggttgggatatttttaacagccaaagtatttccagttccctcaagggccttcatgaaaaaacaatttaagtccaaacagaattaattttaactcactgtagtttaataatgaagcgcaccgtataagaattttagaaggaaagtctgtgcctaattaaactctggcaataaagacagagaagtctgaaggtagagaggctttctcatggttacccagtgtgagactctgattcctggagaccacaattatgcaccaggcagagggaattctactatgcatttgagactttgattatgatgttgtataatggacattatgcacaaatctcagagctggattccaggaaaagattgattggcattccccatcctccagccccatctgctttccgtatgtattccccacaccgagctcattcccgtctcagg

SEQ ID NO: 37945 - DNA, 1161 bp, Neisseria meningitidis
aaagctttactgggacacaggcatgctcattcatctattgtctacagctgtcttcaagctgcagcgtcagagctgaatagttgaggcagagatggtagcttacaaagcctaaaatatttacctggtcctttacagaaaacatttgccaagcgctcttctagtctaaagtacctgtaatatcctttctgcctgggtgcagtggtttatgcctgtaatcccagcactttgggaggccaagccaggtggatctgttgaggtcaggagtttgagaccagcctggccaacatggaggaatcacatctctactaaaaatacaaaaatcagctggacatggtggcaggcacctatactctcagctattcaggagctgagagaatcacttgaactctggaggcagaggttgcagtgagccgagattgtgccactgcactccagcctgggtgacagagtaagactccgtctcaacaaactattttattttcttcatagccgctaccagtatctaaatttctaagttctctctctctctttatttacttacatgtttaaaaaaattgtctccaccaacactcccacaataaaacaatagggccgtaagagcagagactttgttttgtttccttctctatcttcagctattgatacataatgggcttttaaaaagtttattctgtttacattactgacattaaaggtttaacaaattgaagctatctgagaaattgtttgtattgctaagctatatagccattcttttctatcgctgttttgtttgtttgtttgtttgtttgcttgttttgcgacaaggtctcactacatcactcaggctggaatgcagtggcacaatcccagctcactgcaagttctgcctcccgggctcaagtgattctcccacctcagcctcctgagtagctgggaccacaggcgcacgccaccacacctggcttttgtttttttgtttgtttgttttggtaaagacagagttttgccatgttggccaggctggtctcaaactcctaacctcaagtgatctgcccgtctcagcctcccaaagtgctgggattacaggtgtaagccaccgcacttggccccaattttcttttcttttctttctttctttttttttttttttttttgagacagagtctcactctgtgcagg

SEQ ID NO: 37946 - DNA, 679 bp, Neisseria meningitidis
cggcgcattctcagccggagtaccgcaaacttggcccgttcgtggctgatattcaccagtggcaaaatctggatgactattacaaccagtaccgccaacgcgtagttgttttgctttctcaccccgccaacccgcgcgatcacaccaatgttttgatgcacgttcagggttattttcgcccgcatattgattccacagaacgccagcagctggctgcgcttatcgacagttatcgccgtggcgagcaaccacttcttgcgccgctgatgcgtatcaaacactatatggcgctttatcctgacgcctggctttcagggcagcgttatttcgaactttggccgcgtgtgattaacttgcgccattcaggcctcttatgactacccatctggtctagaataaacacaaatatacgtctgcacgataatctcgcactggctgccgcctgccgcaattcgtctgcacgcgtgctggcgttgtatatcgctacaccacgccagggtctgacgcataacatgtcgaaacgtaaagctgaacttatcaatgctcaactgaatgggctacaaatagcgcttgcggaaaaaggtattcctttattgtaccgtgaagtggatgactttgtcgccagtgtcgaaatagttaaacaggtgtgcgcggaaaacagcgttacccacctggtttt

SEQ ID NO: 37947 - DNA, 629 bp, Neisseria meningitidis
cggcgatcaactactccatcaatgcatatattgaagtatttgatcaaattacctggggcgcactggcgtgtgtaggactggtactgatgatttggctgtatcaggcgctgaaattcagaaaccgcgcgctggcgctggagtcttaataggccagcaccgatgcctgatgcgacgcttgacgcgtcttatcaggcctacgtatttcctgcaatttattgaatttgcacaaatttgtaggctggataaggcgttcacgccgcatccggcatctgggctcgattgcctgacgcgtctgttatttccccttccgcgccgcctcatacgctgccaacgtttgtactctcgcttctttgtgctcgactatcggttgcggataatccagcgtcacacctgctttctgcgcccacttccacggctcatgcaccactttccctggcacatcgcgcagttccggtagccactggcggataaactcgccctcatgatcaaatttctcgccctgggttgtcgggttgaaaatacgaaaatacggcgctgcatcggttccggttgaagcggcccactgccagccaccgttattggctgccaaatcaccatcaatcagctgcgacatgaaatatcgctcgcct

SEQ ID NO: 37948 - DNA, 657 bp, Neisseria meningitidis
cccagctacttgggaggctcaggtgggaggatcacctgagccagggaggttgaggctgcagtgagccattactgtgccacagcactccagcctgggtgacagagcgagaccccatttaaaaaaaaaatagtctttaaactaataataataccactaccttgcatctgtaaagggccaccttttccaaatttccccttcatatgccaagctgtgtaagaaacaactctttgagatttttagggcagctactattgattccactttacagcaaatctgaagccaaggccaggcgcggtgactcacgcctgtaatcccagaactttgggaggccgaggtgggtggattacgaggtcaggagatcaagaccatcctggccaacatggtgaaaccagtctctactaaaaatgcaaaaaatagctgggcgtggtggcacatgcctgtaatcccagctactcgggaggctgaggcaggagaatcgcttgaaccagggagtcagaagttgcagtgagccaaggtcgtgccactgtactccagcctggccacagagcgagactccgtctaagaaaaaaaaaaaaaatctgaagccaaaagaagaaaggtcacatttccaaaataagcataagaattttatctcatcctaagcaagagactctgttt

SEQ ID NO: 37949 - DNA, 176 bp, Neisseria meningitidis
atggcttgtactacattgtgaatatataaaaatccattgaattgtaaactttaaatgggtgaattttatgtcaattaaagctattttttaaaaaagacctatatgaaaaacttgaattttggggagttagttgtattaaccaggccctatccagtctttttttcaaaattagagat

SEQ ID NO: 37950 - DNA, 532 bp, Neisseria meningitidis
ccggaagaaagtgaactctgagtagagcaggggaacaccgaagatgctccagtgcagatcaggaaggagcaggggatgaaatgttacaaattctagaactcagagagctgaaggtaattacttccttttcaagttgtgaaacatgttaacctgtggtaaaatacttataagatgataattaccatctaaccgtgttgaagtgtacagttcagttgtgtgaagtatattcatgtcatttttttttttgtttttttttttgagacgagtctcactctgtcaccaggctggagtgcagtggtgggatcttggctcactgcaacctctgcctcctgggttcaagcagttctcctgcctcagcctcccgagtagctgggactacaggcgtgcatcaccatgctcagctaatttttgtatttttagtagagacggggtttcaccatgttgcccaggatggtctccatctcttgaccttgtgattcacgcctcggcctcccaaagtgctgggattacaggcgtgaggaaccgcatctgg

SEQ ID NO: 37951 - DNA, 632 bp, Neisseria meningitidis
ccatgacaggtcctttttttctgtctgtatacaagattaggggagtgtttggtgggaatagtctgctctgatgaggaggcagtcattctggtgttcctgtttgctgcgtaatgtgggaacacattttgtccagcacttctggataaaacacacaaaccaggctcgacaaactcccccagtgccacatcacttgttcatttcaagaaagatagctgaggccgggtgcagtggctcacacctgtaatcccagcactttgggaggccgaggagggtggatcaccaggtcaggagattgagaccatcgtggctaacatggtaaaaccctgtctctactaaaaatacaaaaaaattagctggggtggtcacatgtgcctgtagtcccagctactcagaaggctgaggcaggagaatggtgtgaaccggggggcggacttgcagtgagccaagatcgctccactacactctagcctgggcgacagagcgagactctgtctcaaaaaaaaaaaaagaaagccaaccttcaatcacttcagcatcctggacagttccgagcacattgcaggcataatagctgtttgagggcaataaatagcagtcctcaaagccattgagcaaatacctgcttcccctct

SEQ ID NO: 37952 - DNA, 680 bp, Neisseria meningitidis
ccgaatcctagctagatttgtccgccaacaatatctgaacccctggcctcttggaaaaaaaagagagagagagagaatataaaatgtactatacagggttaaattgacacttccttcttgaagtatttagaagtactaatggagagttgaaaagggaagcatgatttcctccctatgtggcaatgttgtttaatgcaatgcaggacagcttcccagtgcttcaagtcttccacctcctgaaacactgatgtggagggggaaacacaggccttaaagatcagaggcctgaattcgagcccctgctctgccacatacttgctgtgtcaccttgaacaaattacacagcctccgtgggctttggggataaatgtgagacggcatagagaactcatctcctctgctgactgattctgatcctttggtttgactgcctgagcaccatgtgatgagctctgtgagggctccatggagggaaaatgcagtcatctattggtgatatctgctatggacaacatgagttggaaattctgccagccagactatgtcttcaaggactgtgaacaaggtgtcttctgaagtcacttccagatcaaaggacttggtgactcgttccaatgggactggaatacgagagggactctatatcatcatggttattttctaaaggccctgaagaatct

SEQ ID NO: 37953 - DNA, 680 bp, Neisseria meningitidis
cccaggctggtctcgaactccagaccttgtaatccgcctgcctcaggctcccaaagtgctgggattacaggcattagccaccgtgcctggcttttggtgtccttctcgtttagtccacactcctggccacttcccaggatgcaaactggctcacaaggattggattaggacccattccaatcaaataataataacaaacatttgtttatttttggcttctggatattaattttaattactttgaaacaacataatttactaccagatgtttaacaagcacccattataattgctaaactgtgaatttagttttaactgtgtctgaccaactatacaaaactcatcaattttaattttgacaaaaggtagtaggctgggcatggtggcttatgcctgtaatcccagcactttgggaggccaagatgaatggatcacttgaggctaggggtttgagaccagctggacaacatggtgaaacctgtctctactaaaaaaagaaaaattagatggccatgatggtgcacacccgtaatttcagctacttggaaggccgaagcagaagaattacttgaacccaggaggcagaggaggttgcagtgagccgagatcatgccactgtactccagactgggctgagctacagagcaagactctgtcttaaaaaaaaaacaggcgaaagt

SEQ ID NO: 37954 - DNA, 610 bp, Neisseria meningitidis
ccggtattaggaaagagacaaaccactttgtcctgggctgggagggaacaaaaccgtctccctcaactccctaaaatcaaattcagagaggactgtcaaggtggacccatggagccccagtcaaggtccagaaacaaggattcaaagccttcaacataaagtcaccacgaggctagaagagaccagatgaatgggctggcctggtacctgagtcagaaagtgggagtgcgtgggcattggtcatggtgccataatggagacagtgagcacaggagttaaacaagatggctctgaggccaggtgccctgggttcaatcccagctgcgtaactttcacgtggccttttccagttcccttacacactctgtacctcacatgaatgaactggaaaatgaagactacagcactactgacttcagaggattgttggattaagttattaattcacttagaacacaacctggcacatagtaagtgttcagtaaatgtttgttattccacaccctccctcccttggccccgcgatggaggaagcaggctaggaccagccctcggagctgcagctgcccttcatccctccctcggcctctctaacgagatcctgctccag

SEQ ID NO: 37955 - DNA, 1279 bp, Neisseria meningitidis
aaatttactcaaccattctggaagacagcgtggtgattcctcaagaatctaggactagaattaccatttgacccagcaatcccatttctgggtatgtacccaaaggattataaatcatgctactataaagacacatgcacacgtatgtttattgtggcactattcacaatagcaaagacttggaaccaacccaaatgtcctccaatgatggactggattaagaaaatgtgacacatatacaccatggaatactatgcagccctaaaaaaggatgagttcgtgtcctttgcagggacatggatgaagctggaaaccaccattctcagcaaactatcacaaggacagaaaaccaaacaccgcatgttctcactcataggtgggaattgaacaatgagatcacttgggcacagcaaggggaacatcacacaccggggcctgttggggggtggggggagggggtggggatagcattaggagatatacctaatgtaaatgatgagttgatgggtgcagcaaaccaacatggcacatgtatacctatgtatcaaacctgcacgttgtgcacatgtaccctagaacttaaagtatatttaaaaaaaaaaaaccttccctttcttgaatgtaaattggttcaaccattgtggaagacagtgtagcgattcctcagagatctagaactagaaataccatttgacccagcaatcccattatcgggtatatacccaaaaatatataaatcattctgtcacaaagataaatgcacacatgatcattgcagcactaatcacaatagtaaagacatgtagtcaacccaaatgcccatcaataatagactggataaagaaaatgtggtacatatataccatggaatactatgcagccataaaaatgaacaagattatgtcttttgcagggacatgaatggacctggaagccattatcctcagcaaactaacgcaggaacagaaaatgaaacaccccatgttctcacttgtaagtggaagctgaacgatgagatcacatggacacagggaggggaacaacacacactgggtcctattgtgggggtggggtgggggagggagagcattaggaaaaatatctaatgcatgctgggcttgatacctaggtggtgggttgataggtacagcaaaccaccatggtacacgtttacctatgtaacaaacctgcacatcctgcacgtgtaccccagaacttaaaaataaaaaatacccccaaacacactccttaggtatatgtaactatttttcccgggtac

SEQ ID NO: 37956 - DNA, 1025 bp, Neisseria meningitidis
gtaaaccaaattcgaggattgtgtctaggacttgaagggccataggcattgcaaccaccgccaactccctccttttactaatcgtagtgctttatggccataaagcactctttctaaatctaaaaatgatttagaagaaggaaaagaccaatatgatgataacaatgtgggagattccttttatcttttgtagccaaatgacagtaaggaaaacagacagtatgctgacctcatcgtttctctaggttgccagtttttttcactaagatgtatataaatgaaacccttttgctctgcaggctattatactattccttttaaattcagcatctcttccctcctccgttcatgcagattgtggaagagaacatcattgggagagagagtttattggttactgctcacctgagtaagcagtaagcccaagtggcagaaaaacccattcaaactggcttgaagcaaaaagggaattattggaacatgtaattgaatagttttaggtgtagggctgacttcagacgcagctggatccagagactcaaatgatgccatcagaaacatctttggctctttgtcttatatgctgaaaaccactgaattgtgcactttatttatgtaatttttttttttttgagacagagtttcactcttgttgcccaggctggagtgcaatggccccatctcggctcactgcaacctccacctcccaggttcaagtgattctcctgtctcagcctcccaagtagctgggattacaggtgcatgccaccacgcctggctactttttgtatttttagtagagacagagtttcatcatattggtcaggctggtctcaaactcctgacctcaggtgatccgcctgccttggcttcccaaagtgctgggattacaggtgtgagccactgcacccggcccaattgtgtactttaaatgggtgaattgtaaggtgtgggaattatatctcaacagagctgcccccacttccccaaaaaaggaccaagaggtgaggaagtggagacaatat

SEQ ID NO: 37957 - DNA, 2140 bp, Neisseria meningitidis
catgtcaaaatcctaatctccaaggtaatggtattagaaggtaaatctttggtaggtgatcaggtcatgagggtggagccctcatgaatgggattagtacccttataaaagagaacccagagagctcatttgctgcttctgccatgtgaagatacagtgaaaaaagaagcaggcccttgccagatacgagtttgccaatgccttgatcttggaattcccagcctccagaactgtgagcagtaagtttctattgtttataagctacccagcctatggcattttgttacggcagcctgaatggactaagacagtctacctagaccattatttccctttcatcatccaccagccaattccagcacatcttttagatctcagcttaaatactccctccaagacctccctctatctctaatatgaatgaaatccatatctcaagttcttcacagaatcctctactctttccttcatggcatttgtcataatttgtaattatatatctagcaaagttctttgttgttaaacatctacctcctccactctcctagaaactccacaaggacatccctgcacccagtgcctaggcaatgccagacacatagcagatgctccattaattatctgtcgaatgactgaatggcttccaagttagttaactgggcacccttgataacagattctggcctatttgaaggatcaaagaagaaagtggtgctaccttctcccctgccactatcttgcccacttgtggtgccagttcaggaggtttggaatggatgtggctaatgatagacgtagacctattgcctttcttggatcataattctgccaggctctgagtccatgtggcatcgatggctaattgtcctccaaaatttatcctctcttcttccatttataccctcccatggagttttaacagggcatgtggtcaccctactgggatctcacttctcagcttcccttgcaactggatgtggccttgtgactaaattctcatgaacagaatgtgagtgcaagtgatgtgtcagtatcttcatcactttcctaaaaagggaactgctggtcctccacttcctctctttcacccttccaatgagccagaacatgcatgtgatgctggtgagtcagcttcagtcacatgaataaaaacaaactccaggagatgactaagcaataagacagaaggaacccaagtccctagacgagttcacagaaccaagctacctatccaaccctgggcccacctggattataacatgagaaaaacataagtcctaatcatatttttgaagcactgcattttagggcttctttgtgacagcagcctaccctctagtctaatcaatatacctcaccaagtctcctgctcctaagggagacaaagaagcaaaatgagtctcaaaacatcatccaaatggaatagatacagacctgtaatcccaacactgtgggtgcccaaggcgggtggatcacttgaggtcaggagtttgagaccaacctggccaacatggcaaaaccctgtctccactaaaaatacaaaaattagccggacgtggtgttgtgcacctgtaatcccacctacccacgaggctaagccgggagaattgcttgaacccaggagggggaggttgcagtgagccgagatcatgccactgcactccagcctgggtaacagagtgagactctgtctcaaaaaaataaataaaaataaaaataaatagaccattaattaatagatatagccttggtctgtgaccaaagctcagaatgttatgatattcctttcctatgtcacctcaacttgcccctgtcatcagacaggacaaattccccactggtcctttgcactcacagctgttacatttgaaatgggagcttagccttccctgccctggttcctccttagactcatttgggaaaacaggaaacgtaattatttctgccattacctttatctcatggagcctgacagagtgtaaccaatggtaggaattaaaacactctaattgccaactcacaacaactcccgaaaaaaatcattttaactcattatacatattaaattatgacatgcttaatgtccaaacctaatagattcagtactcaggaaatcccttatacaggtagacacgggtac

SEQ ID NO: 37958 - DNA, 866 bp, Neisseria meningitidis
cttagattaatgggcaaaaaagttacaatcatgggatgtttggcttccctataaagactaatgttcatagattgtttttcaaaaatgaggactccccactaaatgggtccagctacacacatggtcctgcaacacgactcagataagggggacctgaaggctaaactcttaacacttttctcagttctaaatttcttcctaaggggagtagaggaagtcacaccccaggccagaactaacattccactgatctcaaatttttagacaaggcttctcctcctaagccaattacaaatcaawacatctttaaatctacctttgacccatgggttcccactttgagacgtcctgcctttttaggtcaaaccaatgtagagcctcccatatattgatttataactttgcatgtaacctctgccttcctgcaattacaaatccttacctataagccatccgggagcttgggacttaagcattaactaattatctttgcttggtgcccctccaataaataccccacttcctcttgctacaatcccaatatcaatgtttggttttgctgtgctgggcagggggacccaagttaggttcagtatcagcaagaaggcaagacagagtgtgtgctagcaagacagaagtccgtgtgtttggtaacctaatctcaaactgaaatgccatcacctttgctgtgttctactgattaaaagctagtcacccatatgttcattgcagcactattcacaaaagcaaagacattgaatcaacctaggtgcccatcaatggagaattggaaaaagaaaatgtggtacatatataccatggaatactacacatccataaaaaggaacaaaatcataccctttgca

SEQ ID NO: 37959 - DNA, 813 bp, Neisseria meningitidis
cccttttctcggtggaatgtgcttctccttcatacatgatataacttgatttgaacaatgtcacaaagatattttctctgttagattaaaattttgtttgcatgaatttttcaatagctttaagcagttgaatagcaatatatgcaggaagaagctgagagacttatgtaatagatatttcatgtatctataacccacactgctgcccaggaaatgtgcgctgcattaatagagaggattttttcctgctgaataccttgaggagttggccaacacgtttgggagtagaagtagaaagggccaggtgtgatggctcatgcctgtaatcccagcactctgggaggccaagtggggaggattgcttaagcccaggactttgaggccagcctgggcaacagagtgagactccatctctaaagaaaaaaaatcataaarractaaaattctctgccaaaatggacacagaaaaaactgacaatccagagaaagataatatgcaatgaagctagacatggccaaattagaaaatgatattgagagagaacaagagcaagaaagaggagccctcagcattgagagggctgaggaagcacagaaatgactgatgggttggttagttagttactttttgtgaagtgtgcaatgtaaatttcactttggtctccccaccggaatcatcaactaaagtctacactgctatatcggctatctattgctgtgtacaaattattccaaactcagtggcttaaaacaacacatttattatctcacagtttctgtgggttagggattcgaagatgggcccctgcttca

SEQ ID NO: 37960 - DNA, 634 bp, Neisseria meningitidis
ccaaccaacatgtacagtatctcatgtacacagtcttctaaggattgacactgaggttgcttctggatttttgcaattacagatagtgctggatacaaatctttgcaaatataccttgcacgcatgcatgagaatatctggagaataaattcctagggtctaattgtgggtctatttaaattttgcataaaaatttgatacatgttttctaaccacctgctcctcccaagaggttgcaccagcttacagtcccaccaatcagggaagagggattttatttttttattttttttttttgggacagggtccggtcctgccacccaggctagaatacagtggcgtgatcatggctcatggcaacctggtcttccccagttcaagcaatcctcccgcctcagcctccccagtagctgggatgatagccgcatgccaccacacccagctaatttatattttactttttgtagagacagagtctcactatgttgcctaggtggatcttgaattcctgagctcaagcgatcctcccactttagcctcccaaagctctgggatgacaggtgtgagccaccatgccctgcctgagaattgtcttctcacacccttgttaataggactattatcacattttaaa

SEQ ID NO: 37961 - DNA, 685 bp, Neisseria meningitidis
gtacccgtttcttttggtgccaatcttgagcgcgcgtaaaccagcttctccgcgctcttcatagaccttcagccacctggctacagaaccactaccagcaagcataaagtgagcagcagcctgattaagggacatgtgctgctcgatcacagctttcacgaccttaatacgcaactctggatcagcactaacgcctttaggtttgggaattaaacctttttctccatgtttttcatagagggcaacccatgtcctgacctgggttcgggggacaccaaaacgtgccgagatgatcctgtaaccatcatcagttgtgaagtagtgattcacgacttcaaggcgcttttcaaaagggtattttggctttgacatattaggggctattccatttcatcgtccaacaaaatgggtgcagtacactggagggctatcagtacactacctttacgcccgccaccctcgcgtctcggaagccttaatgagcgccctggcgagacccgcgagcaaggctacgccctggacagcgaagagaacgagcagggcgtgcgctgcgtggcggtgccggtgtggaacacgagtcccgcgtcatcgccgccctgagcctgtcgacgctgacctcccgcgtggacgacgcggagctggctaatttacgcgagcagcttcagcaggccgggctcgcgctctc

SEQ ID NO: 37962 - DNA, 591 bp, Neisseria meningitidis
cctggatctaggcgtacgtcaactattccgccagcagcagcgtgcagccggttgaggtgctcaccaccatcaaaattctgttctgcgtggtgccggtggtgctctacgcgggcatgttcatcatgctgtcgctctacaagctcaccgatgcccgcgtggaggccatcagccggcagctgattaagcaccgcgcggcgcagggcgaggccgttcccgacgccgcgacagcgcatcccattaaccggaggcaatatggaaatcactaacccgatactcaccggcttcaacccggacccgtccctgtgccgccagggcgaggactactacatcgccacctcgaccttcgagtggttcccgggcgtgcgcatctaccactcccgtgacctgaaaaactggtcgctggtcagcaccccgttggaccgcgtgtcgatgctggacatgaagggcaacccggactccggcggcatctgggcgccgtgcctgagctacgccgacggtaaattctggctgctctacaccgacgtgaagattgtcgactcgccgtggaaaaacggccgcaacttcctcgtcaacgcgccctccatcgagggg

SEQ ID NO: 37963 - DNA, 698 bp, Neisseria meningitidis
gtaccgcggattattgttggttaatgctggtgttccgtactgaaccaccagttgccatgtctgaaacttaataaaatcgctgatcgacttggcgtacgattgcacaatcaccagtacgccaaacatggcgggcgtcatccctttaccggcacacgagagcgccaacagacccagcaaggcgctcacgacattactggagcctaaccaggcgctattgcgaataatggtgcgaaacgcgccatctgcaaaccaatgtttgatgttaaaacccgccaattcagcctgaccttatcgttgatagtaaaaagtatcccgccagccttaagttaaacttcggcggtcagaaacgatggcaaccagagaaaccgccttctgtgcctgttccagcacttcgctgtagggcgctctggaatcaatctcaagaatttttgtgccgttatagccaatcttcgacatgacaccgattttgtcctgcagctcggcatagtcatggtcaggcttgcgggagatggcagtctcaatatcaatgcccaggcgaataattaattccgggcgatattgcgccatttgttggtataaacgccgttcgcgctgcgccagaaacatgctgattttcccggtcgcacgtacgacgccaatccccggtccatcataataaaagcccgaaatttcagcctgcgggaagcgatcgctgacca

SEQ ID NO: 37964 - DNA, 755 bp, Neisseria meningitidis
ccggattttcccatcaacggtaattttgtcactgcacgaccgacatttccggcctgttttcctaaatgaactctttcggcagcaccatatttttcgacaacggtaataagatgttcacacaccgttgacttgcctgaaccatcgctaccaataacggcaattaatggaggtgttattgactgcatgaatatatcctttaatttaaatatccattaaaaatatttatttggttaatatgtttttatgaaagcgtaattcaggtcaatgtcacaattaaccattgtcacaataaggttgaacggatattctgagcacggaccacgtaatattcaatacattatttactgccgggtttttcgtgaatcaacgtaatatgtcaataattaattccacgccaggcgtgttattgccattgtaggatgtgatggttcaggtaaatcgaccctcacggcaagcctggtaaatgaactggcagcaagaatgccaacagaacacatttatctcgggcaatcgtccgggcgaattggcgaatggatttcacagctccctgttattggcgcaccttttgggcgttatctgcgaagtaaagcggcacatgtgcacgaaaagccctcaacaccgcctggcaatattactgcactggttatctatctgctttcctgctggcgggcgtacaagtttcgcaaaatgttgtgtaaaagccagcaaggctttctgctcatcaccgaccgctacccgcaagttgaagtgccggg

SEQ ID NO: 37965 - DNA, 909 bp, Neisseria meningitidis
gtaccggcgctacctggctcaagtccgagctgtgaacactgtacgatcgcactgacaaaactcatagtgtcacagtttcctaacgccggaactttacgaatttctgtggtggcgatacggatcatacgttcagccgtcatatggcgtggaagagctgctgccagttgctctttcattgatggctggttaataaaactaatcacgtcgctatttttaactgctgctggtgcacggtttccctgagttttttgcagatcggcttttgcgattggtggttgcttagtcatttgcatattccttagcccagcggggcagtgataatgtcttaatagctggccattcatcggtattcaggcagtcagacagggttcgcagattgcggtgatattcctgttgacctgccagtwttgcttcttcgcccatcatgaaaatttcaaccggataacgtccgcattcaatagttgtgctggcaaccagaaaaacgaaagttggctgcactccaaactgtgcttcataaccgtcactgtagaatgcatcctgaacgtgatagcggtagtcgtaataagcggttttgaatcgttgaatatccgccgtagttttcacgtccatgatccagtgaaattcagggataattttgtccggacggcaccgacacaaaattcctgtttcaggatcttcccagtaaattgatgattcagcgtgtccggcgctttcaacaagccattgccccagcggcaaagccataacgctttgatacatgagtacaattttccggccttcttccgcagtgataaccgtttttcctgtgcttgcgcattccatcagaaacgctttctcttcttcttttccggcgtttgtacggcggttaaattcaggtgctacgataaagcggttactgaattcttccgg

SEQ ID NO: 37966 - DNA, 1206 bp, Neisseria meningitidis
ctgccacgaattttcctgtcgttaatgacctgcccgctgaaggtgagatcgattttacctggagtgaacgctatcaactcagcaaagactccatgacatgggaactaaaaccgggagcagcaccagacaacgctcactatcaaggcaataccaacgtcaacggcgaagacatgactgagattgaggagaatatgctactcccaatttctggccaggaactgcccattcgttggcttgctcaacacggcagcgaaaaaccggtaacgcacgtttcacgcgacggactccaggcattacacattgctcgggctgaagaactaccggctgttactgccctggctgtttcccacaaaaccagcctgctcgacccgctggaaattcgcgaactccacaaactggttcgtgacactgacaaagttttccctaatcctggtaattcaaacctgggactgataactgcttttttcgaagcatacctgaacgctgactacaccgatcgaggactgctgacaaaagagtggatgaagggtaatcgtgtttcacacatcactcgcacggcttccggtgctaatgctggcggcggaaacctcaccgatcgcggcgaaggtttcgtacacgatctgacgtcactggcgcgcgacgtagccactggcgtactggcccgttcaatggatctggacatctataaccttcatccggcacacgctaaacgcattgaggaaattatcgctgaaaataaaccgcccttttctgttttccgcgacaaattcatcaccatgcctggcgggctggattattcccgcgccatcgtggttgcgtccgtaaaagaagcaccaattgggatcgaggtcatccccgcgcacgtcactgaatatctgaacaaagtactgactgaaaccgatcatgccaaccctgatccggaaatcgtggatattgcctgcggtcgctcctctgccccgatgccgcagcgagtaacagaagaaggaaaacaggatgatgaagaaaaaccgcaaccatctggaacaacggcagttgaacagggagaggctgaaacaatggaaccggacgcaactgaacatcatcaggacacgcagccgctggatgctcagtcacaggtaaattctgttgatgcgaaatatcaggaactgcgggcagaactccatgaagcccggaaaaacattccatcaggaaatcctgtcgatgacg

SEQ ID NO: 37967 - DNA, 1334 bp, Neisseria meningitidis
ccgtgtttgcatcaaatgactggcctgttcaaggacccattgacccagcaatgtgtggttattatgaaaccagaggcagaacgagctttctctcttttacctagggggctgggagtatttcaagtgtcttccgatttttataacccgcagtcctagaattaaccccgcaccccactgccatttactctctcaatgtagagttgctttgagtaggtaacagcttaaattcttagaaagctgagccccctagaggaaatttctaaggtcaagcactcatttgcaactttttattcgctaaaaatgtagagaagggagaagtcaagaataacactgctaaaagggaattttattttattttatttgtttatttatgaaatggagtctcgttctgtcgtccaggctaaagtgcagtggcgtgatctcagctcactgcaacctccttctcccagattcaattgattctcctgcctcagcctcttgagtagctgggattacaggcacatgccaccatgcctggctaatttttatatttttagcagagacgaggtttcaccatgttggccaggctggtcttgaactcttgacctcaggtgatctgccttgcctcagcctcccaaagtgctggtattacaggtgtgagacaccgcacccagcctaaaaaggaatttaatatggacaaagagtacgatccacaaaggagagacaactttatgagcccctttgagcacagcataatactgtctcaaaatatagaatgtgccggctgccgtggcccatgccagtaatcccagcactttgggaggccaaggcgggaggatcacttgagcccagaagtgcaagaccagcctgggcaacatagtgaaacctcatctctacaaaaaaatttaaaaattagccaggtgtagtggtgtgtgcctgaggtctcagctacttgggaggctgaggtgggaggatcacttgagcccaggaggtcgaggctgcaataagccatgatcacaccactgcacccaagcctgggtaaaagagtgagactgtgtcttggccgggcgcagtggctcacgcctctactcccagcactttgggaggctgaggcgggtggatcatgtgaggtcaggtgttcaagaccagcctggccaacatggcgaaaccccgtctctactaaaaatacwataattagctggatgtgcacatgcctgtaatcccagctactcaggaggctgaggcaggagtatcacttgaacccgggaggctgaagttgcagtgagctgagattgtgccactgcactccagcctgggtgacagagcgagactccatctcaaaaaaataaaaataa

SEQ ID NO: 37968 - DNA, 1091 bp, Neisseria meningitidis
cccagtcctgagtatttaaaatgtttcatttctgtgctgagagacagaattagcacttgataaggttgcataaaatgcctggcacacaggagatgctcagaaagcatttatcctttcacccagcttcataacctcttcataaaaaaagttgcagacacctctcctcacatgcacagagaaatatgggactattcaaagagatggaccagccacctcccttccctccctgggtgttttgctgctcagagaattctgatgcttagatcacatcttgggaaagggctccaaggcccagagctcatgcgcttgcctgtggatggtggaggtattcctcatgttaaagttggaggagctgatcctctccagaaacgcctgggccagctcaggtgtgatgtcatagaccatgtccagctgcttggtggcgttgtcatagctgataaacagcccaatctagttggtggacaaggacgagaatatcagtgaggagggtggaagtggcccagtgtggccccaccctggtggtctgcactgtgccccatcatggacacttggatacacctcctggttctcattgtcattgatgtctttttttcttttctttttttttttttttttgagatggagtctcactctgtcgcccaggctggagtgcagtgacatgatctcagttcactgcaacctccacctcctgagttcaagcaattctcctgcctcagcctccggagtagctgggactacaggtgcccaccaccacgcttggctaatatttgtatttttagtagatatggggattcaccatgttgtccagggtggtctcgaactcccagcatcaagtgatccacccgcctcggcctcccaaagtgctgggattacaggcgtaacgaccatgcctggcctcattgtcattgatttcttagtggtctgtaactgctactttagtttcctcctcaacctaactattctttaggaaagaattattttttaatatctgagaaactgggctttttaaaagctaatctttgcacatttatttctagatttgttatatggaggtcagagaatgtggtccacaaactttctgcgttgaagaa

SEQ ID NO: 37969 - DNA, 1157 bp, Neisseria meningitidis
ccctggaatagcatagttaggagtgtgggcccaaactggatttgaatcctagttccatcacttagttgtgtggcttgagacaatttgataaattttcttgtgcctcagtttccctttatatgaaatatggttaacaactgtgagattaaaatttgttcacacatgaaaattgcgtaagactgtgcccaacacacagtaaatgcccatgaatagccttttctcatttttatttttttttttggagacagagtctcactctgttacccaggctggagtgcagtggtgcaatctcagctcactgcaacctccgcctcccaggttcaagcgattctcctgcctcagccttccaagtagctggaattacaggcgtgcaccaccacatccagctcatttttctatttttagtagatactgagttttgccatgttggccgggctgggctggaactcctggccttaagcgatcctcctaccttggcctcccaaagtgctgggattacaggataagccaccatgcccagcctatgaaaagccttttgtaatcttacgtttgcttctttgtttgtttgtttgtttgttttgcgatggagtctcactctgttgcccaggctggagtgcagtggctcaatcttggcttatcacaacctcagcctcccgcgttcaagtgatcctcctgcctcagcctcctgagtagctgggactacaggtatgcaccaccatgcctagctaattcttttgtacttttagtagggacagggtttcactatgttggccaggctggtcccgaactcctgacttcatgatccgcccaccttggcctctcaaagtcctggaattataggcatgagccaccgcgcccggcctgtaatcttataaagagatggatggatggatggatggatggatggatggataaattaataaacaaataaaatacttagactgaaagaatatatccaaaagtacccattggtgttatcttagggaaaggagtggttatgggagtctttcactttaacataactgggtatccctgatatgaggccccaagacccctatttcttatcgatcatagtactcatcatattagaattgtttattaatattggcgtttccacactacctagttccctgccccatgtccctggtatctgtcgg

SEQ ID NO: 37970 - DNA, 855 bp, Neisseria meningitidis
ccaaactaaattgtttgagctgctgtcatctgggggtctttttgttatagcagctcagcctatatcctaatataccatgtctccatcaaaggtgggaaaatgaaagaaagacaaaatagcttatatcatgtttcaagaaaaactggacagaacccttttccttgcagaagcaaagactatctctacatccagcccacttctccaacttacctggcccctgagtttgcaatccctgagcactgagatgggaacatatagatgggtctcaggtacacacctgcaggctggggatggtgaaggcaacattccgggaattcagataggccaggactctgtgggacaggtcatccgtccacacgtgggagcttcagttgaagacagacaggaaaagatcacaatgacagattctcctacaagcactactgtactagctaagtgcccaggggacaggtagggatggaccaggggtgttaggactttgtacttggaagtgggaggtttctcttttcttttctttccttttttcttttctctttttttgaaacagggtcttgctctgttgcgcgatcacggctcactgcagcctcaatctccccagcccaagtgatcttccaacctcagccacccaagcagctgggatcacaggtgcatgccacaacacccagctaattttttgtagagatggggtctcactatgttgcccaggctggtctcaaactcctgggctcaagcaatcctcccacctctggctcccaaagtgctgggattacaggagtgaactgctgcacccagcctgaagtaaaaaatttcttaaccaggcacagtgataggatagtttccaattctaggaatctg

SEQ ID NO: 37971 - DNA, 646 bp, Neisseria meningitidis
aactctacaaaaaaatacaaaaattagccaaatatggtggcacatgcctgtagtcctagctacttgggaaactgaggcaggaggatcacttgaacctgggagttcaaggtggcagtgagttatgatggagtcactgcatttcagcctgggtgacagagtgagactctatctctaaaccaaattttaaaaaagtatctatatgtaatataaaaaccacaagtgggccgggcacagtggctcacgccagtaatcttagcactttaggaggccgagatgggtggattacttgaggttaggagttcgaaaccagcctggccaacctaaaaaaatttttaaaaaatacaaaaaaaaaaccccaaaaaaacccactaaaaatacaaaaaaaaaaaaaaattagccgtgcatggtggggggtgcctgtaatcctagctactcgggaggctgacgcaggagaactgcttgaacctggaaggcggaggttgcagtgagctgagattacaccactgtactacagcctaggtgacagagtgagactgtctcaaaaaaaaaacaaaaaaaaaaaacacaagtgagctcatactatacatgctgtcctgtttatatatatagctaagatatatatatgtataaaactatatatatagtt

SEQ ID NO: 37972 - DNA, 722 bp, Neisseria meningitidis
ccagccaacagagaaaagctgggacaagagacaaatgacatcatttgcacccctagatcgagccatgcctgaagtccctctctgaactttccagttacctgaacaaaaaattcccttttattgcataagccagtttcagtttcagttctgttgctttcaaccaaatatcaacctgatataattggcttcatgtttgtctattccctctcccaccatgagattataaggtcttataaattaataggaatttctaaatcttcagatagaaaatttagctatctgagaactagcacacagcaagtactcaatgaacttttttttttttttgaatgaacgaagacaataagagcaaaaaaaggtagagggaaataaagaaggagagaaggagagaaacaatgtccagatcatgtttgaaaagcagggccaccctgcaggcccaaaagctcacacatgccaggagaaacgcctactgctcccctcaactctgattcccctggagcctggcacagccgcaaagccaggccagatgggacctgcctcactgacactcattcaggcttgggttgctttggcttggtttttagataacaggaaaagcgagaaggtctgtctcaaatgtctgtgtgatactcagaattgaaatcctggatctcaagggcttaactctctaaggcatcctccactctgcctctggttcctgaagaaacccagtggggagagaa

SEQ ID NO: 37973 - DNA, 877 bp, Neisseria meningitidis
catgacaactcaccagcctgtattccacccgaatgtaagcttctgtgggcaggaggctcatctgtcttgttcgctgccatgttgctactgccaagcagtccccagtaggctggtcatggctggtgtccacgaacatatttgtgcagcatatgggtgaacatacacacgtcctttctgaaacaaaattgaactcagtaggacactcactcaggcaaagattgggaagctttagatccattctggaggagggggagatagaatcagaatatattcatttaacaaacatttatggggaacctacttttttggcagacctcatgctacagaaacaacagtacacaaagccctgctttcatgaagcttacagtctaccggggactgggagaggcggaccataaacacacacatgcacacatatacatgttcacatccacacacccctgtatcagatagtgataaatattatggagcaaagaaatctggaggaaaggatcgagagctccagatggtgatggtagggataggggtggtgcagaacaagctttaataaaacattaggtggtcagtaaaggctctgccctcaagagggatacaatcgcttcttaaaggtcccacctctcaatgctcccacttttgggattcagtttcaacatgagttttggggggtcatttgaatcaaagcacatggtgtcctaccatcagctctaagtttacagcctaacacttccgcaataacaagaaagagagagagagagagagagagagagagagagagagagagatctttcctagttacttcagcaaaagtccccaggttaggtctgattgggcttgcttgaggcaggtgcccatttctgatctgaccactgtggcccgg

SEQ ID NO: 37974 - DNA, 758 bp, Neisseria meningitidis
ccgcttctcttcttactatttcaagatggctgcccaattcatgtgcagaggaaagagaagttctttctctttactctgacagttgaataaaaaatccaaagcctggctctctttggtccatccctgaatcagtcattatggcctggggaatggagtatgctaattgacttaagggaatcagggcccagcactggagtgaaggtggggctaatgccacctaatccactggagagtaccaaaagtgtgcttccccaaaggaaattcacaatactgtgggaaaggatgaattgatgctgagtcactatgaatgacaaatgcaaaagataaacataccaggccccactccttgcaggaagcaaaagatcctagagggagaggctgacatggaacaggatgtctgaccaataaaacttcttccaatgaggattcacagacatagtcataccttccaggttaagtaaggctcaattccaggcagctgtctgtctcagctcctcatgcacatccgtcgcttctgtctacccagcatttgtttctcccttattcagttctcattgctgtgtaacaaattgacagaagtgcatcaactaaagcaacacaaatgtattatctcacagctctataggtcaaaatccaagcacggctcaaccggattctctgctcagggtctcatggggctgaaaatcaggtgtcagctggagctgtagtcttatctaaagctcaggggcttcttccaggatgattgggttgttttcaga

SEQ ID NO: 37975 - DNA, 670 bp, Neisseria meningitidis
actacaggcatgcactaccatgcccagctaattcttttagttcttgtagaaatgggttcttgctatgtttcccaggctgatctcaaactcctggcctcaagcaatcctcccatctcggcctcccaaagtgctaggaatacaggcatgggccaccatccctggccacacaattgttttttaatttagttatagtagtctgtaccactgtaggatgacaatagttaacaataatatatagtttcaaatagctagaaggaagatactgaacagaaagaaatgagaaatgtttgagatggtagacatgctaattaccctgactgatcaccatacattatacacatcaaaacatctttatgtaccccataaatatgtacaattattatatgtcaatttttttttttttttttgagatggagtctcactctgtcacccaggctggagtgtagtggcgcaatctcggctcactgcaacctccgcctcccaggtgcaagcgattctcctgcctcagcctcctgagtagctgggataacaggcatgcgccaccacacccagctaatttttgtatttttagtagagatggggtttcgccatgttggtcaggctggtctggaactcctgacctctggtgatcagcccacttcagcctcccmaagtgctggggatgccggcg

SEQ ID NO: 37976 - DNA, 923 bp, Neisseria meningitidis
atacctctccaaccccatgtcctactgttatatcctcttcgtgcaatttactgaagaacatgcaaattatgctcctaatatcaaagcctttgcactgtcattttcttttctttctggaactttctttctccagatattcccgtggttcattccttcacttcctgaggtctctgcttaaatgtcacctcctcaggtcttccctgaccaaactgtctataatagtacctgctccttctttggctcctttttcctaccctgttgtatttttctccatggcactcatcactccctgacataatatagttatttgattatctattttctgcctggttcattccaacacaccagcagggagttagttttgtaaactgctgtattctcagagcatagaataatgcctggctcacagcactactcaacaaatatttgaagaatgaaagcatgaaataattacacaaacataaatatgtattatagctgtgcttggtgctataaaagagaagtattggccttttcttctggctaattgctttggcctggtcagagaattcagggaaggcttcattgaagacttgaaatttacaatgaattgatcttagccgggcaaagaggaaggggaagaatcctctgggccgaggaacagcctgtgagagggtcttaatctggggaggatagcaccttggagggacagacagatggcccgggcaggaaccttggggaatgaggggcaaagaggagggtgatacagccactggaaaagctttgggctttatcttgagggtaatggggagaggcggagggtgacatgagtttattgagatggtgtttttcaaaacagcatctgtttgaaaacagcaatctggtttctttgcttattaataaacttgtatacagagctgactttgtgtcagccctgtttgaag

SEQ ID NO: 37977 - DNA, 808 bp, Neisseria meningitidis
ctaaaataaagcctgttttataataaagtgttgaatatctcacataattcattgaacattgtactgaaggggcaaaccagaatggttgtatgggtacttgaagtacagtttctactgaatgcacattgtttttgcaccattgtaaagctgaaaaattgtagatttaaccaatgtaagttggagaccatctgtgttttgttcctccttaakgcatacaaaagtgtagccaaagagtgtttcaaagctggattacataatgaattattattatttttttttgagatgaagtctcgctttgttgcccaggctggaatacagtggcgtgagctcgcctgactgcaacctccgtctcctgggttcaagcgattctcctgcctcagcctcccgagtagctgggattacaggcatgcctggaattacaggcacacgtcaccacacccagctaatttttgtatttctagtagagacagggtttcgtcatgttggtcaggctggtctcaaactcctgacctcaaatgatctacccgccttggcctcccaaagtgctgggtttacaggtgtgagccactgcacctggctgaaaatccagatttttgtccaagattgcagaataaattgcctgggacaagtcaatgagtgaggagagataagtcaatggactgagaaggggtaaactcagtcttgcataaacagaatacagaggggatttgggtggatggggagcagtgagtgaatgggcaaagataggacaaaaccaagcccacttaaagaacaataatattacaaaggacaaagttgagaataagag

SEQ ID NO: 37978 - DNA, 768 bp, Neisseria meningitidis
taatgtttttcttcttttcaaagatgtaatatttctgttaacactatagaaagataagaaagataagaaccttcagggctctttgaagacaaaattgtattctgaattgggcattcattagactgagcggataaatctctaaatctgggttttatgattttaggtttgtttgtttaatggatttctttgcttaaacttcaggtgcatgcatgataattttgaagagcagagagatggacaaatgtgatttgatttataagtcttttcaaaggcatttgaaaatgtatttcaggtttagttaagcttatttttcacactcttagttgaaggcaggagtgattgttttcctccctccacacctcgaaagatggaatggtttttcacttataaatttttccatctcagaaaaggaggagcagaggttttccagaagggttaagaataaaggtggggaaggcaagcccttgttaccataagagcaggaatccatacggaagagtggctggtttagatttgctggcttgagagtggattattttatccaactcttgatcagtgttgtgagaattaagtaagataatggatttaaggggcttagaagtgtccaatcaatgttagctactgttgttattctcagtactacctgtaggcttgatggatatatttggagacatttgtaccaagggttatggggcaataagtgcgtggttcccatttggcccagtgaacttttcaggacttaggatgaggaaggcgggaaaagccctg

SEQ ID NO: 37979 - DNA, 736 bp, Neisseria meningitidis
ccggcgcgatcacagctcgttgcagcctcgggctcctacagcttatgcaatcctctcacctcagcctcccaaacccacaccaccaagcccagctaattttttgtatttttggtaaatacgaggtctcactttgttgcccagactggtcttgaacccccggcccaagtgatcctcccaccttggcctcccaaagtgtgtctccccacctacactcccattctttcccttaaaaaaagtctgagtctgggtgcagtggctcacacctgtaatgccagagctttgggaggctgaggcaggaggataccttgaagccaggagtttgagaccagcccaggcaacacagccagactccgtctctacaaataacacttttaaaaaacttacccaggatacccaaaggactataaatcatgctgttttaaagacacatgcacacatatgtttattgcggcattattcacaatagcaaagacttggaaccaacccaaatgtccaacaatgatagactggattaagaaaatgtggcacatatatgccatggaatactatgcagccataaaaaatgatgagttcacatcctttgtagggacatggatgaaattggaaatcatcattctcagtaaactatcgcaagaacaaaaaaccaaacactgcatattctcactcataggtgggaattgaacaatgagaacacatggacacaggaagggggacatcacactctgggggctgttgt

SEQ ID NO: 37980 - DNA, 891 bp, Neisseria meningitidis
gtacccttctttaaaatcttcaaatatctaatcaggggttcaaatttcctcaattgtctcacaattttttgggtttttttgagacaggatcttgttctgtcactcaggctggagtgctgtggcatgatcatagctcactgcagccttgaattctggagctcaagagatcctcccatctcagcctcctgagtggctaggactacaggtgtgcatcaccacgccaggctaaattttaaatgtttttatagagatggagtcatgctgtgttgcccaggctggtctcaaactcctggcctcaaacaatcctccgccttggcctcccaaaacactgggattaggtgtgagccactgtgcctggcctaattttttattttattttatggtattttttgtttgtttgctttgtttctttctttttttttttttttttggagacagagtttcactcttgtcatccaggttggagtgcaatgggatgatctcggggsactgcaacctctgcctcccgggttcaagagattctcctgcctcagcctcccgagtagctgggattattagcatgcgccaccatgcccagctaagtttttgtatcttwagtagagatgggttttcaccatgttggccaggctggtctcaaactcctgacctcaagtgatctgcccgcctcggcctcccaaagtgctgggattacaggtgtgagccaccgtgcccagacatgacgtgtttgaatcaggatccaaataaagtctagattctacaagtgatcaatcttttgtttttgagttaatagggtctctttctctctctctctgtaatatattggctaaagagactaggttgtttgttttggggagtttccacagtcttgaattctctggctgcacctagtct

SEQ ID NO: 37981 - DNA, 2033 bp, Neisseria meningitidis
ccagtctggagtgcaatggcgtgatctcggcccactaaaacccccacctcctgaatctaagcaattctcctgtctcagcctcctgagtagctgggactacaggctcacaccaccatgcccggctaatttttgtatttttagtagggacgaggttttgccatattggtcaggctggtctcaaagtcctggcctccggtgatccaccagcctcagcctcccaaaatgctgggattagaggcatgagtcaccatgcccagcctaaacttggcaagataataaatcacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgtgactgcgtaagcgtcccccagcatcaccggctatgagatgtgtggcagctgagacccgggaactgctcaagggcaccaggccccatctgtctgcactcactcaccttcctcaggtactcgcatgggcatgtcactgactttacatgctgctgcagctccttggtgagctggccctggtcatgggacaggaactgtggggtcaggacaatagagagcttcaccatttgcagaatgagcacaggggctcatgatgagtgccaacctattagataatttaaaaaaaaaagtgttgaatgagtggaaaaacaaggtgatgtttgagtctatagtggtcaagggcttcagaaaaggacagacccaagttcaaatccctgtactttgaatttctacttcatgccatgcaaaattactttaccccttttaacctcagttttcttctgtgtgaaacaggaacaatagtttcattcgtcattcagtttctctcaagatttcacgagatcatacctataaaacatccaagtcatttaaatgtatcatcatttctgtcataattagtgggatccatttcactattattggatatacagttctgtgcctgaaacctacaaaaaaacaaaatgttaagtctaaaaagcattagtgatttctcatttttatattactaattataaccctatttaatcacacaaggccttgtccgcggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataatgagaatccttagctcattcggttgtggtgaggggtgaatgatttggcacacaggaggggcttgttaaacattagctgtgatgatctccttccaaatcttcattttcagagccacagatgaggccatagtgcaaccaggtgaccttagagtgtaagtacacatgatcgccagctatgctctatctccaccataggtccaagactgggtagttctggcctggaggtttctgctgcatctgccttctcagtgttcacctaaggacttttgtattttcctcctcgcatccccacagatggggttcaggctgccggacacagctgggtgatgccagggcagtggtcacctgtgccagccccgtgaggtagctggaggatcattgttccttccttctcgggctctgggcagatgccagggctggggtgacccatgccctcaagtttcttgctttggtgggccacattttcccttggcaaagagggtaaaggtcacaggatgccggagagctgtgacttctctgtgccctgggcccaaactatgaagacctgacacactatgctaaaagtccaacgctgggtgctccccagagcttcttgcctcaccgcttctgctgagggaggaatgaatactatgtcctcccagagctttgggagcttgtagcaagcagcctccccagcgcaaaatctcttggaaacctctaactgtgtctgaaagg

SEQ ID NO: 37982 - DNA, 666 bp, Neisseria meningitidis
ccacaaatataactttagcaaatatttagcataactatcaaaattacaaatcatattaaatttgtataaatgtatgcaattttcggaacacgcatatcaacaacatacccataaatataactgagatgagatctaatgtcacctcacttgacagtgccctcccatgcagtatcgccacatttgacaatgcctgcccatttaatctaccaaataaatcgaatcacttaatacctctacaagatgagagatacattctttagactccccaagggatgcagctgaaaaaaatcccaaagttagttttaagccaaaaagacttgatttaggattttgacactggagaaacccatcaaagatgtcaagtttgaaaacacttgatcaaaacagaatcacaggtcactattaaaagagtattaatttaaccagagacttccaaagcaatacagaaacttacatggatataaaaaccctaacccttttaaaggtcagatttgctaagtgatcaaaaggggtacttgaattgaatcgacacaggaagagtgtgtacagggttatgagtgtaggcaggtggttactttggtcatatctccatttgccacctgattacacatgagaatggcatctttactcaccagaaagccagtattataggaggtgtaggaggca

SEQ ID NO: 37983 - DNA, 691 bp, Neisseria meningitidis
gtaccattatgttccttaaaacaaatgactcccctgtctactaggcattgttctagagtgctcattggggggtggtttgaagacagtgcatgctgctagctgcaggtactttattgctggtgctttctagcccatcctggtttattctgggatgcctggtgttcagaacctggcaggtgcacatgtgaataggagacacagggagttctcaactggtcagcagcttcctaaagcacaggaagtaaaactccagccctgccaccaatgtctttgcctctcatctgcctcatggggtgtagagaatcatctggagtgtgagagtggggctctggaattaccttgacactggttcaaatccaggcactgccacttagcaatggtctagtcctaggtaactcacatagcctgttaagcctccatttccccatctgtaaaatgggattgtggaatgccttcctgatagggcctcacagtgttgggcacacgctgagtgtgcatcagtgctaacgatcattctcttcttgcaggctctgttcctgtatgagcttctgttaaagaccaccagaaggcctgaggagcttttgaggtaggaaaatgtaactcggcctgggtgctgaacaggcctttcagagccttctgccagagcagcctacttttccaggtgggagagttaggcagtcacatctgtagc

SEQ ID NO: 37984 - DNA, 721 bp, Neisseria meningitidis
ccgggcaactcttcctgctcgaacatgtaggtcttcctcaaagcaggtctagcttccatccatttgctcagttattggcttgcccacctgggcaggtcttttaatatagttcagtggtttgtaccagcaaactgattagaaatgcaaagtattaggcctcaccccttacctactatatgtaaaactctgggagtggggcccccaatttgtgtttttacagccttccacacaatgctgatgcaagctcaactttgagaatcactaacagaattaacagtccaagggaatgagagagcttcattaaaactttgcatattcctgtaatgatcttgaaggattatacaccaagcactctatgcttcctggttttctgggagataatttactctttggaaattcttcattctggtctgaaacacaaggccagagttgagaaggtgctttttaatatccattacaggagtctgtaagccagcggttcacaccaaaagttcaaatgctgtaaggcctgtgtttactagcttagacactgaaaaatcagtcactggctgggtgaagtggctcatgcctgtcatcccagcactttgagaggctgaggcaggaggatcacttgagcccaggaatttgagaccagcctgggcaacatatcaagaccctatctctgcaaaaaataaataaattagccaggcatggtggtgtgtgcctttagttccagctactc

SEQ ID NO: 37985 - DNA, 1367 bp, Neisseria meningitidis
cctgaccccatcagcagagcctaggtcacaagcctctaaattccaaggcccatcacctgtttccctgtgtgatttgaaatggggtcaagctcccatttctccttgaagaactgagcacctactttgaatatctcatcaggaaggcattttattgctgatggctggaaatatggcatcaaatccttgtcaagcatccggagctctgccttagttaatccagctggggagaaaaaggaatcacgggggtttagttcaagccatcagaactccgcttgttttattaatggtgctgcataatgttcagatctgagtgttctaggcaggcatcattccttacaaaaggccctggaaatcacactggggaatcaagttccttcatcaactcagaaaaaaaaaatgtgggtcacattagccctgattggcctcctacagtgaaacgcatgcccagaaggaacttcaatttacacactttcaaattttgtataaacctacttaggggccaattaaatcacattctaaactagcggttttccaaactttagtgtacacaagaatctccaaaagagcttgttttaaaagcagatttgcagacccaccctctgcaacttcaaatcatgaaatgtaggttctactgtaacgccactgatgtttgctacacatggccaaggataatgttttattttgtgtccccacatttaagtttggaaagagagagaaaggtatgctcagggtgagtcttacctgcaatggtcccaagctcctgcaagacagaactggtccactcagtgggatccccaaacacaacttcagccttcctcttaaactcggctaagacatgtgtgctgcagagcagggtcccaattctggccactaccaccctggtagtggttaaagagggagggatataatatgagcttggactcttcagccaaaaacaaacaaacacacacacacacacacacacatacacacacacactgcacagtaggctcagcagggacagcagatccagcttatcccattagcccagtgggattttagcccagaaaggtgccaagtgtcaggaggtggaatatctggatggatggatggatagatggatggatggatggatggatggatggatgaattaacccatttgccattttgcacattcatattttagttacctgaattctgagatctttataagtgggatttcagtgatgtttatagcacacagggttgcaccaagtcctaccaaatgaaagctcttcaggtcctggatactgtatcctgaatcatccaggtacccttgcaaaatggattcagcctaaaaaatagtaagaataaaagataaaccatccagggatgatccagggtcccca

SEQ ID NO: 37986 - DNA, 1180 bp, Neisseria meningitidis
ccggaatctgtctcttatcatgtttttgaactttgcttttctttgtgttggcttcattgagagacaggctctatgcctgcatgtggtaggttccagcagatccttgtgtatatccttctaagttcaagtccagagtaaagaaagctcttcccctaatgctccactcaaagttctggttgactctggttaaatcacatgtccaatccagaaccagtgactgcagctaggctaaggtatgaattgaaattcatcactcctggaacttggtgcagttagctttgactgaaccacatgaagcaggaatacaagagaggtggttctccagaggaagttatgaatgatgaatagccactgtgctagaattatggagacttatgtgtcagccgccttaaatcaaggcttagtttaaaatagtttaacaccaaagcattttgtgtgctactcttggaattgaagagtaaacattggaattgaaggggtgaacatatttctgtaggaccacagaggaagaaaaaatcattaaggggtaaacatatttctgtaggaccatagaggaagaaaaaatcattctggctgaaacctcatgaagaaggtgacatttgagttgaaccaaagaaaaaaaaaaaagaatgtctgcacttggaagtgcagaagggcatttcagatgaaaggactggtttgaacaaaggcaaagagacaggaaattataaggttttgttggaggttgtggaaaggctgggtgcggtggctcatgcctataatcccagcactttgggaggccgaggtgggtggatcacttgaggtcaggagtttgataccagcctgggcaacatggtgaaccccgtctctacaaaaaatacaaaaagccagatgtggtgatgtgcacctgtaattctagctacttgggtggctaaagcacgagaattgcttgaacctggggaggtggaggttgcagcgagctgtgccactgcactccagcctgggtgacagagcaagactccgtctccaaaaaacgaaaaaaaaaaaaaaaagggagaagaaacgttgtggaaaaagatgctggaaaagtttggatcctgatgcagaagaagttgtatgtccaaactgtctgagggtcataagagtgactgaaggaaataagcagcagacacacaggacacaagtgcctttaatattggtg

SEQ ID NO: 37987 - DNA, 707 bp, Neisseria meningitidis
cgaagccgatatatgccaccatataagcgaaaaagagtccgggattttttgctcgccagacatacaccggttccgggcatttttaacccgtttatcaatcgcgcctgcgcgccacctttccatgcttcgcggaaacaaaatatcgggataaggaaaaaaacggcaacgacaaaaaactgctgtacatccataactactttccttgtttcttttgtaattcaagtaactgttcgggtgtgacggcgggatacccctgcgcatcttccggtacctggtgcatagccggaatagggaccagcggccctaaaaaacgcggttcacgtttaaaaatataaaggtcagccagcgcaccgaaacgggcggcaaattcacgaatacgtactgacagcatatctttcggtgacggtacggcataacactgagcctgaatccccatatgcagcgcaataaataatgctcgctcacagtggaaacgttgggtgataataatgaaatcattagtatcgaaaactttgcgtgtacgacgatggaatccagcgtacgaaagcctgcgtaatcgagaacaatatctgatgggtcgacaccagcagcgattaaatctttgcgcatggtcatcggctcattataactttgcaatgcgttatcgccgctcagtaatagataatttaccttaccgctgttataggcattaatcgctccttgaatgc

SEQ ID NO: 37988 - DNA, 737 bp, Neisseria meningitidis
ccgatgtatgtttcacgcgttgcataattaatgagattcagatcacatataaagccacaacgggttcgtaaactgttatcccattacatgattatgaggcaacgccatgcatccacgttttcaaaccgcttttgcccaacttgcggataacttgcaatctgcactggaacctattctggcagacaagtacttccccgctttgttgaccggggagcaagtctcatcgctgaagagcgcaacggggctggacgaagacgcgctggcattcgcactacttccgctggcggcggcctgtgcgcgtacgccattgtcgaattttaatgttggcgcaattgccgcggtgtgagcggaacctggtatttcggtgccaatatggaatttattggtgcgacaatgcagcaaaccgttcatgccgaacaaagcgcgatcagccacgcctggttgagtggtgaaaaagcgcttgcagccatcaccgttaactacacgccttgtggtcactgccgtcagtttatgaatgaactgaacagcggtctggatctgcgtattcatctgccgggccgcgagacacgcgctgcgtgactatctgccagatgcctttgggccgaaagatctggagattaaaacgctgctgatggacgaacaggatcacggctatgcgctgacgggtgatgcgctttctcaggcagcgattgcggcggcaaaccgttcgcacatgccttacagtaagtcgccaagcg

SEQ ID NO: 37989 - DNA, 675 bp, Neisseria meningitidis
ctgataaagacatagctgagcctgaggaagaaaaagagatgtttttgtttgtttgtttgagatggtgtctcgctctgttgcccaggctggagtgcagtggtgcgatctcggctcactgcaacctccacctcccgggttcaagcagttctcctgcctcagcctcctgattagctgggattacaggcacgtgccaccatgcccggctaattaaaaatatttatagtagagatggggtttcactgtgttagccaggatggtctcaatctcctgacctcatgatccatccacctcggcctcccaaagtgctgggattacaggcgtgagccactgcacctggccaaaaaagaggtttaattggacttacagttccacatggctggggagccctcagaatcatggcgggaggtgaaaggcacttcttacatggtggcggcaagagaaaatgaggaagatgtaaaagtggaaacccctgataaaaccatcagatctcgtgagacttattcactatcatgagaacagtatggggggaacctaccctatgattcaaattatctcccaccagtcccccccccaacaacatgtgggacttacaggagtacaattcaagatgagatttggggccaggcgtggtggctcatgcctgtaattccagcacttttggaagctgaggccggt

SEQ ID NO: 37990 - DNA, 1517 bp, Neisseria meningitidis
aaaaaattagccaggcgtggtggcaggtgcctgtaatcccagctacttgggaggttgaggcaggagaatcacttgaacccaggaggcagaggttgcagtgagctgagatcatgccactacactccagcctgggtgacagagtgagactccatctcaaaaaacaaacaaacaaaaaacaacaaaaaattcaacctgggaggtacaaattcaataggtttgtgacagggctttggaatccacatattataaaaactcttcaagtgattccaatgtcagccagaactagtgaccaacaataattcacatcccatggagctccacatgggcactcctgtgagtgcaaagcaccttccggtctctggacacactgaactcaaccatgaacagaaatacggactaatgtacagctggtatttgagttaattatgccaatcatggaaaaaaacagacacagcttctcaccaaagggtgtaacttccaacttctcctaaatagcgctgttctaaagctaggcacgcccatgtgggcagactgaattcaaccttctttcccatgaccaacactctcctgacctctaggaagccacaaaatcgttgcagagaaggaaaagccttctatattctttcccccaccaaaaaaaaaaagaagaagaagaagaaaagtcaaagcctaaagtttttaaaattctagattaataagttggtttgggctagttacaactcaacccttggaaagaataaaggaaatactgttaattaccccatatgagattttaatagagaaaggcttaagggaagaccaccacctagtgaccaaaggcaggatgacattttcagagcacctagctgggctggcaggcagcaatctgttttctctccaagtgtactgagaagggaacgtgggccaggcacagttgttcacacctgtaatcccaacgctttgcggggcaggaggcgggcagatcacttgcggtcaggagttcacaaccagtctggccaacatggtgaaaccccgcctcttctaaaaacacaaaaattagccaggcatggtaatctgtggtcccagctactcgtaagaagtaatgctataaagtgtacaagtggtaaaatgcagaaattaaacagttatgcttttccattagccacgccctcacagacagcatctggcttacaaaaacaaacactgaaagttacaacaacaaaagtgaaacatacttcaccaaacccaaattcaaagccttggaaatagaccaattatgctaagtgctaaatgacatggcagcaaattactcatataaggaatcgttttcaagtttgctaaactattttaattctttcaatctaaagccttaacaaagatgagcagcactagctgtttccaccctttgattatgataaacttcatctccactttcattaataaactgctaaccatattaaacaatccttccgtggaatctgtcccaccacaagtttgatttgctgtttcttcagcatcttcaatatctgccgggatgc

SEQ ID NO: 37991 - DNA, 679 bp, Neisseria meningitidis
gggcttggctgatccatggagatatctgcagcttgccagcagctgaagtctttatttgcctttatctccgttgtggcctctgatgagccagactacagagatgctgatgaaatctgggaggcaatggtggaggctgtagtttcccaggagaactctggccctggggaattccttccagtctctgagtccctgtggcacatctccatgtgtggcggactaggtgattgctcctagtgattctgcttagttcctttattagaattataagctttttgccatgtgactttgtagtacatctcaataggtagagtctaattccttgcccttctaactttgggctttggtcattggaatgtgagcagacacattttcccccagcagaagttttaaatgtgctgcatgatttgacttgacctcttggcaattgcgtctcatgtgaagggacatgtggagcagacctgaactcaacccaaaccttggagccaagctgagctcagcagaacctagctgagcgcagccaagccaaacccagtgtaatcacagccaatctggagactcagaagcaagaaacaaatatatgtgatagggatctattgggagttgagagcaatttctcttttttaaagtaattgtgatcttttgagatggagtctcactttgtcacccaggctggagtgca

SEQ ID NO: 37992 - DNA, 627 bp, Neisseria meningitidis
caataactttttttgtatagccattcattgtctagatcaatgacagaacaacatattttctttttccctcaaaagcccgagtgatcattaaggaaggcgatgtagatgtttcagattctgatgatgaagatgatagtaagtataaaaaggtttaaagcctgggcacagtagcttacacccataatcccagcattttgggaggccaagatgggaggatcacttgaggccaagagtttgagaccagcctgggcaacatagtgagaccttgtctctgcaaaaaaacattttttttcaaatattttcttaaaaaaggcttaaagtagaactaggcagggtagtgtgtgtctttagtcacagctacctgggaggcttaagtgggtggattgcttgagcccaggagttcaagctctgcctggtggcaagactctgtcttctttaaaaaaaaaaaagtaaagcacagaatacctggcatctattctaataagtagactgcaacaaatgacaacttttgatgtaatctttttgttatatttaccattgatatgcagtcagttgtcctgaatgcattatttatataaatagtccatttaattttcattgatgctggtggagaaaagtcttgaaatt

SEQ ID NO: 37993 - DNA, 695 bp, Neisseria meningitidis
ccgggaggccgaggcaggcagatcacaaggtcaggcgttcgataacagtgtggccaatatggtgaaaccttgtctctactaaaaatacaaaaattagctgggcatggtggtaggtgcctgcagtcccagctaatggggaggctgaggcaggagaattgcttgaacccgagaggcagaggttgcagtgagccaagatgacgccattgcactccagcttgggcgatagagtgagactcggtctcaaaaaagaaaaataaaaataaagacagaaaaagaaagaaaaagacctaatatcatctaaaatgaaatcatacaaacaacttttccatgatgttctcaatgaaaagatttcttaccagtgttctctctgattttcgaacaaatggaaatttttccaccagtattggcatgagaaaccacggtgccctatttttaaaaaattaaatcaatccatgttgactttactttctagaaaaggaataaaaaggaaaactaccattctaaaagcaaatatcgatagacataggaggcaaacaggaacccttacctcaaagaactggaactttttttgttttttgagacggagtttcgctcttgttgcccaggctggagtgcagtggtacaatctcggctcactgtaacctctgcctcccgggttcaagcgattctcctgccttagcccccaaacagctggg

SEQ ID NO: 37994 - DNA, 715 bp, Neisseria meningitidis
accctgatgataaattaacaacagaataaaggtcactctggttttaccctaacaaaactcaaaaggaagcatcaaaaggatcaagctgatttgaaagtaacttaagtgtatgacagaacaaagcccaatactcttcaaagaaatacaactaaatcaaatactcaacaatgtaaaatccacaatgctcatcacccaatcaaaattgctaggcttgcaaacaaaaaaagaaaatatgactcataactaagagaaaaatcagtcaacagaaacagactcaaaaatgaccatcatgagggaattaacagtaaggatatgaaggcagctcttataaatatggaatagttaaaagacccagaaacatccacccacctgtcccggggtccattctgtttgccagcttagggaagccacagtgtctatggagctgaggtccagctgctccagctcactctcattaagagccagagcaatgcgccccagggagacgatatggtgttctctccagtaagatggcatgtcccaaacctttaggcaaaaaaaggaaatagattagactgaacactgtgatggtatttacaatgatttgaatgtttgtgcccctctaaaatgcatatgttaaaacctaatctccaatgtgatagtattggaaggttgggccttgggagatgattaggtcataagggtggagcctcatgagtgggttagtgccttgtaa

SEQ ID NO: 37995 - DNA, 603 bp, Neisseria meningitidis
cctgatccaaataacaatataacaataaaaaacaatacacataaaaatacagtagcatttttgacataacattttgtacatatttacatagcacttatattgcatcaggtattataactaatctagagatgatttaaagtatacatgaggatgtgcatagattatatgcaaatactacactattttatataagggacttgaatatccatggattttggtatctttaagaagtcctggaaccaatccttggtggaggtatccacaggggcaacttcattttatttatggttagttcttatttatttagctaattgttagactttcaggttgcattaaaaaaatgcctcaatgtatgcctttatacatatactgttgggtacttgtctcatttactcaggctaaattcccagaggtggaatttctgggtcaaagaatataaatactttaaaagcttttgatacagatagccaaattgccctctcaagagtatgtaccaacttatattctcaactacaacaaatgaggggtacccttaccttgtatctttccagtatcgtaaatggtgataagtctttatacttcttgacatgtgaagaatcaaca

SEQ ID NO: 37996 - DNA, 640 bp, Neisseria meningitidis
  misc_feature (43)..(43): N is any nucleotide
cgaaaactgtctaatgcgtaaccggaaaaggcgttcacgcgcnatccggccactttcagttttactctttctcggagtaactataaccgtaatagttatagccgtaactgtaagcggtgctggcgcgtttaatcacaccattgaggatagcgcctttaatattgacgcctgcctgttccagacgctgcattgacaaactcacctctttggcggtgttcaagccaaaacgcgcaaccagcaggctggtgccaacagaacgccccacgaccgcggcatcactcaccgccagcatcggcggcgtatcgacaatcaccagatcgtaatggtcgttcgcccattccagtaattgacgcatccgatcgcgcatcagcagttcagacgggttaggtggcacctgaccgcgagtaatcacatcaaagcctcctttgccaaaatgctggatcactttgttgagctcatctttacctgccagatattccgacaagccatgttcattactcacggtaaacaggttatgcgaataaccacggcgtaagtcggcatcaataaataacactttttgatcggactgggcgatcaccgctgccagagttgaactgacaaacgttttaccactgtctggcgtcgcaccggtgatcat

SEQ ID NO: 37997 - DNA, 710 bp, Neisseria meningitidis
ccggcaatggctggaacagaaagagatcccggatccctatcgtaaaagtcaggacgcatttgaacatgtctacggtatgttggagcgcgccagtcaggaatgggcgacgcctcagccggtaatttgagtttataaaatacgatgacaactaaaaatatgaatacgccaccaggcagcactcaggaaaatgagatcgatctgcttcgtctggtcggcgagttatgggatcaccgtaagtttattatcagcgtgaccgcgttattcacgctgatcgctgtcgcttactcgctgttaagcacaccaatttatcaggcagatactctggtccaggttgagcaaaaacagggcaacgccattctcagcggcctgagcgatatgatccctaactcatcgcccgagtctgcaccggagatccaactgctgcaatcgcgcatgattctcggtaaaaccattgctgaactgaatctgcgcgacatagttgagcagaagtattttccgattgtgggtcgcggctgggcgagattaaccaaagaaaaaccaggtgagctggcgatcagctggatgcatattccacaactgaatggtcaggatcagcaactgacactcacggttggggaaaacgggcactatacactggaaggtgaagagttcaccgtcaatggtatggtcggacagcgtctggaaaaagatggcgttgcgctgactatcgc

SEQ ID NO: 37998 - DNA, 658 bp, Neisseria meningitidis
  misc_feature (145)..(145): N is any nucleotide
  misc_feature (502)..(502): N is any nucleotide
acccggcggaaacacccgcagcagccgctcggtgccgaacagtttgaccagccccgaaaacaggacatacatcagccccgccgcaatgaggccccccgccgccgctgccgggcccatctccttgatgaccagcgccgtcggcgantaaaaggcgaacgaactccccaggaaaatcggcacctgcccgcgcgtgacaggtgaaaaatcagcgtggcgaccccggccccgaacagcgccaccgagggcgacaaccccaccagaatcggcaccagcaccgtggacccgaacatggcgatggaatgctgcaaccccagcaccacccggcgctgcggcgggagatcgggaagggggggcggcgcggcagtctgcgtcatggggaaagtgtagtgggcagggggaggagacgagagacagaaacatgcttctgctgtggccttcttttcgctgctccacgtccaacggagaaacgcagaacgccagggccgtcgtgcacgaatgcggnagcctcgcgtctgtagaaatcacgagcatccagaccaccccacgcacttgaggaacactgacctgcacgcgccatcaccgcaaggtgcatagcgccacgtttaaggcccctgcccctctggggtaaggggtttaggggcggggcaaaaagctaaag

SEQ ID NO: 37999 - DNA, 339 bp, Neisseria meningitidis
cccggctgaacaacctgctgctggtgctgatcgggctggtggtggtgctgacggtgcagctcgtggggaccaccctcagcgtcacctgctgatcacgtccagcgccgccgcccgcctgctctcgcggacctgcggaccatgatgctgctcgccgccgctctgggcatcctcggcggggtcaatgggctgtatgccagttattacctcgacaccgcgccgggggcgaccatcgtgctggtgaacacggctatttttctgctggcgctcgcgtttcggcggaagtaagggcgcttccctaaccctccacgggcaacaagcgcaattcgcccgtgtccgcct

SEQ ID NO: 38000 - DNA, 540 bp, Neisseria meningitidis
gtaatcccagaactttgggaggccgaggcaggtggatcacaaggtcaggagatcgagagcatactggtcaacatggcgaaaccccatctctaataaaactacaaaaattagccaggcgtggtagcgcacgcctgtagtcccagctactcaggaagctgaggcaggagaatcacttgaacccgggaggcagaagttgcagtgagctgagatcataccactgcactccagcctgagtgacagagccagactccatctcagaaaaaaaaaaaaaaaaaaaaaaatatatatatatatataaatataaaaccagtctaggatcagacttcaagtttcactgagctggaagtggctgccaatgctccccagctctttagcaaaagacatttacacacgatattgtattggaggcatttggggaaaatgaaggaagtggggagcatttacagggtgcagtgactctaacatcaagagctaattacaagagccgtgggcaatgacagatgccaaaacaagatggaggaatcaacttttatatagact

SEQ ID NO: 38001 - DNA, 755 bp, Neisseria meningitidis
ccttccaaggtgccagctctggaacgaaggatgcccttgggaggtgatgacactcaggtacacgggtgctcaacagattgcttcctcctatcctcagacggtctttgcatgcatgcagccattggcactcccattgtgtggaaggaaaccagcccagggtcacacagctggtcagcagcaacatagctggtctcaaatctaaggtgcctgaccatgcctccatgagggaccgcctccaagggaggttgatcctggctttggggagcctttcctgggctgcacgaataacctccattgttcgagaccccaaactctgctcacatcttcctttccctatctctgcttgggctatgatcacggtgactctagcagcccttcatggacattatagtactctctgccattcacttttgctctaatctgacttcaacccccacttacttggtctctccttttacaaccaccacaaccgaaatctagggctgcttttaaaaaattatttttttgagacagagtctcattccattctgtcacccaggctggagtgcaatggtacgatctcggctcactgcaacctccgcctcccgggtccaagggattgtactgcctcagcctcctgagtagctgggattacaggcgtgtgccaccatgcctggctaatttaagtatttttagtagagacggggtttcacatgttggtcaggctggtctcgaactcctaacctcgtgatcgcctgcctagcctccaaagtgct

SEQ ID NO: 38002 - DNA, 737 bp, Neisseria meningitidis
cctggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcaccgctaacccacctagacattttaacatccgaaaccgagtgatgacgtccttatctatatcatcttactgcctgtgtgtgtggactttaaattctgaacccaaatgagggggagaaaaccaagttgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcacctttsctggccctgtcctctgctaaacttcccacaggccttctgcacgatcacacagagtatgcccaaactctctcaggcctctggcagctgaaaaccac

SEQ ID NO: 38003 - DNA, 557 bp, Neisseria meningitidis
cggggggaaaaaagaataaaaggatttaaaaaatacaactatgttattttgggatggaaattcatctgatatacacacgttcaaggtgtccagattagtgccttatatcacaccccaacacaatacacaattatggtgcaagcctgtaaactgacctaggtcatgaaggaatttaaatataataaaccaagccccttttactacatacttatataaaatcgacaactatcacatgatgctctatgtcaggtagcctcaacaaattcaacatttattctagctctgatatggtctggctctgtgtccccacccaaatctcacttttataatttattttttttgaggcagagttttgctcttgttgcccaggctggaatacaatggcaagaacttgggtcaccggaaactccggcccccaggttcaagagattctcctgcctcagcctcctgagtagctgggattacaggcatgtgccactgtgcccagctaattaagtatttaaagtagagatgggggtactccatgttagtcaggctggtctcgaactcctgacctc

SEQ ID NO: 38004 - DNA, 655 bp, Neisseria meningitidis
cgggtcaggaagggattcctacggaagtgatttttcctgtttggcctttcttaagggcagattataattataaacagttaaaactttgtttaaggaggcccgcactaaggtgcagtgggaatgaaaggaagtggtagattctagtgacattgtgaggaaaggtgaactggtccttgagactggtttggaggaggggaggcagacagtaagggaaaggaatccttcaatagttgctccctgtggaatcgaatcttggtgttgccattaatggtagttagaaatatgaagaggaggctgggtgtggtggctcacgcatgtaatcccagcactttgggaggccgaagcgggcggatcacgaggtcaggagatcgagaccatcctggctaacatggtgaaactctgtctcactaaaaatataaaaaattggccgggtatggtggtgggcactatagtcccagctactcgggaggctgaagcaggagaatggtgtgaacctgggaggtggagcttgcagtgagcccagattgtgccactctgctccagcctgggtgacagagcaagactctgtctcaaaaaaaaagaaaaaaaaaatatgaagaagaggcagttggaagagtagttccatcttggccaggttcagttgctggtgggcagc

SEQ ID NO: 38005 - DNA, 733 bp, Neisseria meningitidis
cggtaggtttcagttccagctctgcctcttattgactgcaacctcaggcttaactttcagtctctgagcctcagtttcaactctgtaaaatgaggtggctataccatctcaggttgcagagagaattaaatgaaatataagtgcatgtagagcattgaacccagggcctggcacacacagtgagtacacaatgttagccaggtagcttcataatgcatactgattgtcaatattcagacaatgcagtaaagtgttaccaaaaataaaagtaaacttatttgcatatgtattctttcaatctttatttttaaacagggtaaaactatgcatattctttcatagccagtgtttttctcttcatagtatattgttaaaataattttacttggaccgggtgcagcggctcacacctatagtcccagcactttgggaggccgcggtgggcagatcacgaggtcaggagttgacacgagcctggccaatatggtgaaaccccatctctactaagaatacaaaaattagctgggcatggtggcacacacctgtagtcccagctactcagaggctgaggcagaggaattgcttgaacccgggagacagaggttgcagtgagccaagattgtgccattgcactccagcctgggggacagagtgaaactctgtctcaaaaaatatgtgtgtgtgtgtgtgtgtgtgtgtgtgtgtgtgtgtgtgtgtgtgtgtgtgtgtatgg

SEQ ID NO: 38006 - DNA, 709 bp, Neisseria meningitidis
cctgactcaatgtcactcaattgattctgagttcactgctgattacatccgaccaaactgctttttctgaagtctactccgtttaatcatgctggtgatgattttgtgcggctctgggacaaactccacctggctgaagataaagcaaatctgcggtgacttagtcctcctgtcatttcccatcagttccccactctcctcctctgcccctccacagtctcccatgcaggctgacaccatatgacggccttaatggagtccaccgagtatttcaggttctctcctgggccacttgaaagtggatgtacccatgggatttgctttgacccaggagatgtgcgtggaagtgaagcgtgtcacctcgaggcaaaagagttgggagccattgagacgggccactctctccttcatctcttagagcagctgacagctcccatatggaggctgctcctttattctcgtggcaggatgagggcatgtggggcacagggcacaggagagccatggaggatgtgcagcatgggcaggaaaagagccttcagtggtgtacatttccatagtttggggctgtttcttacctacagtgatacctagcccatcctaacaggcatgcaccatctactccacactctgtgatgcagactagcctgccgtcagaacacgaactggtggtcagacacaggtaggtttcagttccagctctgcctct

SEQ ID NO: 38007 - DNA, 720 bp, Neisseria meningitidis
aagtaagttcggaaaagtacatttatatgtcaccattactaatacacttggggtaaggtgtattctcaaactctaatgttcatccagccagtcaaggtgccttggaaattgtgtaccctcctcagcccaatagaccttgggcctctgaagaaaactattggaagaaagtttcaagtgggcagtcatgggattgttttagtgtggaagggctaagaaaagaaaaagaattgtggacaactaagatcacatctctgatgtgagcaaacatgatttaaagggattgttggctatgaaccaaaaatcatttaagggtatttttgtactggagaaggccaaggacaaaagatataaagtttcccatccttgggatcatgaactcaaagcaaaagcaaaatggattaatagctacttctatttatagctacttctgttaatagctacttgagcatgagcaatggttagattttaattctagagtttacagtggagaaatacacacattctaggattacttaactcactagtcaacctgtccctctccttatgatgttgacccaatgacactaaaatcccttgggcatcatgattcttgaatgcggtctccaaagaatgctgccaacacaaaggggatcatgaagagactgtgggccttgcttccaatttttcttcttcttcttcttcttttttaagtcatatgtgccctgactcttctggccagtg

SEQ ID NO: 38008 - DNA, 1040 bp, Neisseria meningitidis
gtacccctactaaaaacacaaaattagccaggcatggtggtgcatgcctgtaatcccagctacttgggaggctgaggcaggagaatcacttgaacctgggaggcagaggtttcagtgagccaagatcgcaccattgcactccagcctgggcaaaaagagcgaaactctgtcaaaaaaaagaaaaagaaagaaagagagagagagagagagaaagcagagaggctactgcagagaaaagtctagaaggatgggttcatgggttcatcgagagacaatagcttaacaaccagcacaccatagttggcaaaacactatcattgaaaaaaaaacatgctcaaaaggggaaatgccagtttgggtaaatatgcttttgtgttggagagaaagaatttggaacaggcttttcagacccccttaaggcccaacaaacaaattataatttagacaagtctgggattcttcacagctcagcttgtggtgatggtattagcttcacaactccaaacaagttaagctgtctgtgtgaaatctcctcaacaacacctcactggcaaacctggaggtgctgaaaacagagctttcaattcttgtttgcaaccaagggagttgagttggcagatgggcactgtgtccagccttgggaaaggacatcgcagactttgcatcctaagaactcataaccacaacggcaaggtaagacacaagctcttgaaagtttccatcacagtgcagcacaaatgaccttggctatgtgccctgttattgctggtccctgcttaaaaatctcctgtgacttccaaccacacaaatttcctacctggttgcaaaaatgcccttgataattcacccctccctctatcttgccccctttacaatgtggcttggcagctcctcccatcaagagttaaaatctatttcctcaccccttgaatctaggctggccatgggacttgctttggccaatagatgtggcagaaattatggcgtgacagttctaagcatgagtctcaagaggctttgcatgcagcaactttctctta

SEQ ID NO: 38009 - DNA, 689 bp, Neisseria meningitidis
aggccaaaccccttaggttttagggtttttttctttttttgagatgggaatctccctctgtcgccaggctggaattcagtggcatgatattggctcgctgcagtctccgcctcctgggttcaagcaatttccctgcctcagcctcccgagtagctgggactacagaagtgcactaccacacccggctaatttttcgtatttttagtagagacggggtttcaccatgttggccaggctggtctcaatctcctaacctcatgatccgcccaccttggcctaccaaagtactgggattacaggcgtgacccacctcacctggccaagtattggtttcttaacagattttgccattggacagaacggacctgatagagcaagatgtcaaaagactccctgacaagtaaaaaaggggccaggcatggtggctcacacctgtaatcccagcactgtaggaggccggggcaggtagatcacttgagcccaggagtttgagaccagcctgggcaacatggcaagaccccatctctagaaaaacaaaaattagtgagcagcacaggcctgtagtcccagctacttgggaggctgaggtgggaggatcccttgagccccagaggtggaggctgcagtgaaccaagatcacgccactgcatgctggctggggtaatagagcaagaccctatctaaacaaa

SEQ ID NO: 38010 - DNA, 848 bp, Neisseria meningitidis
cagaacaaaggggtctgggaagaatgacagcatgactgaagggctccgtctggaaaggaaggatagtgtgccaccaggagaaggagagccaccccagacaccaacagctgagacaatcccagccctgggttcatggcccaaagtcacagcccactcaccaaccccaaawacataccccytgtgacatgtggctgagcaccagacatcttcctctcaccttgctgaggataccttgctgctgggcaggtgacaagtcggatacatactgggagacggcacttctcaggacctgcgagatgtccttgcgtttcatgctgcagaaggcctgggtgctgaccccagccagcagtgcgcccatctggctgacattgtagaaagacagcacctggaagaggagcggtgcgcagtcaggctctgctcccgcctttcacctctccaacgtgcactcagcccatctatgtgccaagtatagggatgggtgacaccttaggggcacagcagtgagccagacagatgctgcctccacaggccttccttccttctatcaagaaagagagttggccaggcatggtgctcacgcctgtaatcccagcactttgagaggccaggcgggtggatcacctgaggtcaagagttcgagaccacctggccaacatggtgcaaccccatctctactaaaaatacaaaaattagccaggcatggtagcaggttcctgtaatcccagctacttgggaggctgaggcaggagaattgcttgaacccaggaggcagaggttgcagtgagctgagattgtaccattgcactccagactgggcaacaagagcaaaactctgtcagaaagaaagg

SEQ ID NO: 38011 - DNA, 694 bp, Neisseria meningitidis
gactacaggtatgcaccaccatatgctgcccaggctggtcttgaactcctggagagagatacatacacacacacacacacacacacacacacacacacacacactttttttttttttttgagacacagtttcgctcgtcacccaggctggagtgcaatggcacaatcttggctcattgcaacctctgcctcctgggttcaagctattatcctgcctcggcctcccaagtagctgggattagtaaggcactgccaccatgcctggctaattttgtatttttagtagagacagggttttgtcatgttggccaggctggtctcaaacttctggcctcaggtgatccacttgcctcggcctcccaaagtgttgggataacaggcatgagccactgcgccgggcccatacatatgcattttaaaaaatttatttatttatttcgagacagggtctcactctgttgcccaagcaggagtgcagtggtgctatctcccaggctcaagcaatcctcagcctcccgagtagctgggactacaggtgtgtgccatcacacccagataattttaattatttttattttttaaattttttgtagagatggagtttcaccgtgtcacccaggctggatatttttgtatttttgataggcctgtacagtttccaaagttgcaacctttccccctccctgagagtaggg

SEQ ID NO: 38012 - DNA, 707 bp, Neisseria meningitidis
ctgtttaacacagtaagcaggagctcgataaatattaggaatcatattacgctaattgttttacaaggtttgcttcacttacacgtataaattaatgaaaaaacatagcatcctaatgactctgaaagttaaacgccaagagtgctatgggggttagggattttaaaagtggagcaaaataaagactgcgaaacaaatacgtgtgtcgaaacaaatttcaaacaaaaaagatgtaatattcaatttgccatgagtgacaacgttcggctgataacccacatagcccagggaaatcccttccaaatttggacgaagaagagggaaggaagaggggtcaaggcgcagaaggcagtacccaggcctgggaaatcacgaagagacacagtcgggaaagtgggcctccagaacagagaacatactcacttttccaggccccacccatgtctattacccagttaggaggaatgagctcatttctgtgaacgtgagatgaccctcgaccccgtgctcctatcacacgccattagctttgtcccacatcctttcaatccgctcctctaagcgcggtcctgagctttggtcccagacgcgcagaaggaagcggcctgaatcttacccagtcctcgacgcgcccagcgtcttgactgcagaggacgaagcggccgcatctcccgacaaacaacgtgtgaagcagcggtgccgccatt

SEQ ID NO: 38013 - DNA, 752 bp, Neisseria meningitidis
caaaattggtgcttaacgaatatttgttgggtggatgaaagcaagcactgactgtcaactactatcactgggggtgattaactttgtctcctcatgcctggccccagtctgcacttagtaggtgcatggtaataataataaaatatctaacacttggacaggcatggtagctcacatctataatcccagcactatgggagaccaaggcaggaggatcacttgaggctcagagttcaagatcagcctgggcaacacagtaagaccctatctctacaaaaaaataaaaaattatccagatgtggtggttcatgcctgtagtcccaactacttgtgaagctgaggtgggaggatcccttgagtccaggaggtcgaggctgtagtgaaccatgattgctgcactccagcctgggtggcagagcgaggccctgcctctataaaatcaaattttaggccgggggcagtggctcacgcctgtaatcccagtatttcgggaggccaaggcaggtggatcacctgaggccagcgttcaagaccagcctggccaacattgtgaaacccgtctttactaataatacaaaacttagccaggcgtggtggcacatgcctataatcccagctagtcaggaggctgaggcaggagagttgctgtaatctgggaggtggaggttgcagtgggccgagatcatgccgctatactccagcatgggtgacactccagcaagactccatctcagggaataaaaaaaatcaaa

SEQ ID NO: 38014 - DNA, 714 bp, Neisseria meningitidis
ccagaaatctgcccccatgatccaatcacctctcactgggccccacctccaacactggggattacatttcaataagatttgggtggggtacacatccaaactatgtcaaatataaagtttagtaaaaacttagaaatagcaccaaaccaaaaaaggggtaggtacacatacattttttttgtttttttctgagacagggttgtactcccatcacccaggctggagtgcagtggcatgctctcgactcactacaacctcagcctcctgggctctggtgatccttctgtctcagcctcctaagtagctgggatgacaggctcatgccaccacgactgactaatttttgtatttttagtagagatggggtttcaccatgttggccaggccagtcttgagctcctgacctcaagtgatttgcctgcctcgacctcccaaaatgctgggattacaggtatgagccaccacacctcgcctaacctacattttttgtcgatattaccagattgctctgctaatagtgcacagtttgacagtcccacggaaaaatgaatgtgcccagcattaagtattagcacttcattttatttttgacaatctgatgggtgaaaagtgatttacttatgttttttagactttattggattttcattgaagttgagtatcattttataggattctatatagagaccacattagtgggactaggggatagat

SEQ ID NO: 38015 - DNA, 376 bp, Neisseria meningitidis
atcagagtcacttcatcttctgtgaaatttgcaaagatgctaggaggttcccctcctgctgggacaccccagcccagacacaaaccattaattcacaattacatggagtttcactgtctgcaaggctgctccatttaagctctgggtcatgaacacataactctaggcatactgacactagctgggagattttccaccaaaaaaaaaaaaaaaaaatgccatttcatgactattaatccaaaataggtaaatgtgtctggcttatagaataccagcctgattacaaatgcttggtgttggaatggcccagctcacagtggttgtagaagtccagtaggcccaggctttgtggctcactcctgtaaccccagcactt

SEQ ID NO: 38016 - DNA, 518 bp, Neisseria meningitidis
ccgccaagccgggctccgcagttgaggcgcgcgcgggggcctgggcggaggactcacggggcaaagcgctgggggagcgggtgggcgcccaccgctgggcctccctagggaaggggtgcaggtgatggatggcgtgggggacagaccgagagaaagagggtgggcaaagtgtgggtgcagcggctttaagggctcctgggattggagggcacttggaggggggggacgatgaaacttcgagaaaagggatccaaaactacttagtaatataataacagcgatgacaactgttgcaataactatcacaatgattatttgttataataatatagcagcagtaaaaacaatagcattagtaataatagctacgattcattgcattcttatatgtgccagtgctgggcttagttctttatgtattttatgtataaagtaatgcctacctcataacagttgtgtggaagaaatggaaaaatgcaggtaaaggccggggctcacacctgtaatcccagcacttt

SEQ ID NO: 38017 - DNA, 703 bp, Neisseria meningitidis
cggtacccgaccatcatcatcgtgggactgactttggtggaagtccttggttacatgtcattattgcatttccgacaagttataaagttgtcattaccctctggatagtttacctttgggtgagtatactaactttctgtagaggtatacttgtaatcacaaataagaataaattatataaaacaattcacatttctggacttcattatgaatatgtggttttacccaaaaaatcagggaaatgatttattagtataagaattatgaaaacatctgccatttgcattatgaaaattaaataggtcggtgtttgtttaatagaatgtcaacagagcttttggtcaaaaataagtttttttaacctttgtgctatttatcacaaatggagtatgaggtttcgtcacttaaataggaaattctttctaaactcttctgctttatagttctatcgtatgggtggaaggaaagcttccaatctcctctctgaagattcactgcagaaatgagctgacaacagacagcttaacaggaaaagaaaaacatagaacaggcataaacatgggaaccagctgaaaaatgagactgctagaagggccggatggctgatgcttaaagagcaccctcttctgaggggagagggagatagatggagatgtaggccatttagaggggcagcaaatgatttttaggggaaatgaaagag

SEQ ID NO: 38018 - DNA, 576 bp, Neisseria meningitidis
ctgcttcagcctcccaaagtgctgggattacaggcatgagccaccacacctggcctgaaataatatctttcaaattctttgtagaatttgttttttcctgatttctgcacataggataaaaaaaaaatcatgtactaggatttcgagagaagcaatgggtaatctaaaaagatgaaaagagcaaccacgtcaatcccacagctactgctagatttcataggaaaggtagctggcccagtttggagctaggggaaatgtcaaacacatgaagaaatgagaagccaagaaatgccatcacgcatgaatgcttcatggcacccatgatgtccctgctaaggaggtaatggtatagatgactagatgacaaggacaaagatgagaggtgcgaagttgtccaagtccaacagctcaactgaactttcctaagtggaattgttaaaaagtggtaaatttaaaaacttcacctggctcacgtggtggctcacgcttgtaatcccagcactttgggaggctgaggttggtggatcatttgaggtcgggttttgagactaagcctggccaacatggtaaaacccc

SEQ ID NO: 38019 - DNA, 725 bp, Neisseria meningitidis
cggcgcaaatcacctggatgggtgtgaaagattccgaccatacccggaaagacggaacgcgcattgaaacggaaggcgacggaaatgtgcaaacgcgacttggggtgaaaacctacctgaacagccatcaccagcgtgacgatggtaaacagcgtgagttccagccttacattgaagcgaactggatcaacaatagcaaagtctacgccgtgaagatgaatggtcaaaccgtagccgtgaaggtgcgcgtaatctcggtgaagtacgtaccggggttgaggcgaaagtaaataacaaccttagcctgtgggggaatgtcggtgtgcaactaggtgataaaggctatagcgatactcagggcatgctgggagtgaaatatagctggtaaaccgtataagccgcatgtcgagatggcatgcggcttaatattgccgacttcaaacggcgcatcaacgccttatttaaatcctcctttttatccgcgatcgcggatatcgcagcgtttatcccgtagagcggataagatgtgtttccagattgacttatcctcactaaaggataaaacgcataatatccccttaagcggataaacttgctgtggacgtatgacatgatgagctttcagaagatctatagcccaacgcaattggcgaatgcaatgaaactggttcgccagcaaaatggctggacgcagagcgagctggcgaaaaaaattggtattaagc

SEQ ID NO: 38020 - DNA, 730 bp, Neisseria meningitidis
ccggcttaaccgtccatgcaacctcaacacattgctttcaactgccgtcaccacgttctccggaaaatctgtcggtaatgaagtcttcacgttatccagtgctgctggaatcattctggcaaagtcactcaggatttcatgcatctgcacttccgggaatctcagcacctttgctgtcgccaaaaaatgtcgcggataaattttatcgattgccgtttttttgcctttggatgcgttaagccccattgccagtttgagatcgctgatgtgtattcccgtaccgccaaggaccggaaatgctgaaatgatgtcgtaaaatggcgtgagtcgataactgccgccagcctgaataaatacggagaagttttttgcatgaccgtccgttgcgccaatcaaccactggaagacctggaatttcataaaatcatagcgatctttcagcgcctcgctggaccccatcaaaaaagccatgatccgcgcgatgcctgggcctccatctgattcatatttcaccgatgaaggtaaaccgaatgtctgacacatatcctcctgtggcaagcgaagtaaaaccgttcgctcagcattccaacgcctgtcaaaacgttcgaccgctaacgcgcgcacatttcccgctttaatgatttctgcgtccggaacattcaacccaagttctttcgccagcagcagacagtaatactcattatcaccgctttggctgagatcgagcgtc

SEQ ID NO: 38021 - DNA, 687 bp, Neisseria meningitidis
gtaccccatacagatcacctggggatcttaaatgcagattctgattcaggagctcttggttgaggcccaggactcccatcttcctcttcttcctccttcttcccttggcctcccaaagtgtttggattacaggtgtgagccattgcgcccagctgacgctgcacttccaacaagcttccaggtgattctggaaccgctgctctggtgagcacacctggagcggcaggagataaagcagtggttctcaaacctgcctctagattagtaacatccctgccaggtgccaccctcagagaatctgatgttattgttctggggtgtggcctgaggtatggcctgattttaatgcttctcaggtgatttcaatgcagccaggattgagaacactggattgcagggtggttatgagttcccaagaccagatgagcaaacacgctctctctcattttccttcctctccatctctctcttcttccttccagtcaagtctcaattctacccccttccattccactttttgtggcccttttcaatttgcttaaaatcgaaacgatgacatgaaaataatattaaatgaaattttgataaagccatcaataatttcacagcagtatcccacacatcaccataaagtccccaaacacatttgacatttgagagtgtggtcatctatttaggtcagcgcat

SEQ ID NO: 38022 - DNA, 697 bp, Neisseria meningitidis
cctttactcttcttaaaattatctcttgcacctctttgcacatttctatgatcattttaataattattttattgcaatatgcctgcctaatgatagtaaagtgtgcgttacagctgctttcggtaaggaatgtgataaagtcacctactatacaatgagctctgtaacaaaaaacaagaatggttcatattttaacacccgaatttacgtaataacgtagtcatttcaggcaggtgcacaaaacgggtttctggcaatattgaaatagccactggggggcagcagagtgaagtagaagaaacaactgtcaaagcgcctgggttctctaagttcggcaactgccttacctagaaatcagtttccacatctgtaaaacgaaggggtggactacagtggcagctcccaaagtgtggagcacacccagcggcatctgcaacacctgggaacttgttagaaacgcagattgccaggctgctcccggacctcctgaatcagagactgggtggggctccgaaatccagggatccccagactccgggtcacagatggggaccaccgggaccctggcctgttaggaaccagccacagcaggaggtgagcagcaggccagtgagcattaccgcctgagctctgcctcctgccagatcagaagcggcattagattctcctaagagcaaaccctattgtgcactgtgca

SEQ ID NO: 38023 - DNA, 466 bp, Neisseria meningitidis
aaagttggagggtacttttgtgatgggtttggtttaaattggtttaaaatataagacacatagtccatagagaattcacctatggactatgctgctaagagaatctcaaagagatgcactgttatgctccagagttttgtgagaggccactaaggtcaggagacacatgccatatatatcaagatgctgtcaacagagaaaaccagtgaggtttcaaacagaagccccgctccattcaaccaggcagccactcctcattgcaggtgctgacctgggctttggctgcttctcacatgggcaactctatacactctattcctgggagaagggcagcaaagacccacttattaaatgatgtttaacaatcctcggccgggcgcggtggctcacgcctataatcccagcactttgggaggccgaagtgggcggatcatgaagtcaggagatcgagaccatcctggctaac

SEQ ID NO: 38024 - DNA, 575 bp, Neisseria meningitidis
attttcatggacagcaactcatcttcctggtttttattttttattttattttgacacagggtctcaccgttacccaggctggagaataggtgtgatcacggctcactgcaatcttgacctcccaggctcaggtgatcctcccacctcagcctgctgggtagctgggactacaggcatgtgccaccatgcctagctaatattttgtagtttttttttttttagaggtgaggtcttaccatgctgcccaggctggtcttgaattcctgggctcaagtgatccttctgccttggcctcccaaagtgctgggattaaagacatgcgccaccgcacagcccatcttcccatttttataggaaggctgctgcataattttggaatctttatgctgggctgcaaactcaaaggcatagggggtaagataggcaacagaaattgtgtatcgagtgcttactgtatgcgtggcactgttctaagtgctttacatataacacatttagttttcacaaccatcctatgaggcgattttatttccattttatagacaagaaaactgaaatacagagaggttaaatag

SEQ ID NO: 38025 - DNA, 695 bp, Neisseria meningitidis
ccctctactaaaatacaattattagccaggcatggtggcttgtgcctgtagtcccagctactcaggtggctgagacacaagaatcacttgaacccgggaggcagagtttgcagtgaacaacagatcgcgctgctgccctccagcctgtacgacagagcaagactctgtcttaaaagaaaaagaaaaaaaaaagaaagaaaagctaaaacaggccacaaagggaccttttccttttatttatttatttgagacagagtctcgctctatcaccaggctggagtgtagtgacgcaatctcggctcatggcagcctccgcctcccgggttcaagcaattctcctgcctcagcctcccgagtagctggaactacaggtgcatgccacctgtagagatggggtttcaccatgtgggccaggctggtctcgatctcttgacctcgtgatccgcctcccaaagtgctgggattataggcatgagccactgcacccagcctatttttatttatttttgagacaaggtatcagctctgacgcctaggctagagtgcactggcgcaatcttggcttactgcaacctccacctcccgggttcaagccattctcctgcctcagcctcctgagtagctggaactacaggcacatgacaccacgcctggctaaagtttgcattttgagtagagacagggtttcaccatgt

SEQ ID NO: 38026 - DNA, 694 bp, Neisseria meningitidis
  misc_feature (173)..(173): N is any nucleotide
tgaaataatgatgtgtttgtatttcataatctatgttgtgtcctagtttttcagtggaatataaataatgatggtaacttagattcaatgtgaaccttgagtaggggtacaagttcaaaatctgtataaaaaaatctatattaaaatgagagaagaggctgggcgtggtgctncacgcctgtaatcccagcactttgggaggccaaggcaggaggattgccggaggtcaggagtttgagaccagcctgaccgacatggtgaaaccacatctctactaaaaatacaaagattaaccgagcgtggtggcgggcacctgtaatcccagctactcaggaggttgaggcaggagaatcgcttcaaccggggaggcagagattgcagtgagctgagattgcaccactgcactccggcctgggtgacagaggcrrctccgtctcgaaaaaaaaaaaaagagagagagacagaagagaattttattaggaaatctaggcaataaaacacagaaatttaactctgagcgtcctggctaccaaagcaggtaggtcaggatttatttatttgatggatgttgcttaaagcctccttgtgtcctagagcagtcaaattcatagagacagaaattagaatggtggtacagtttcgattttgcaaggttcaaaatattctggatatggctggtagtgacggttgcagg

SEQ ID NO: 38027 - DNA, 632 bp, Neisseria meningitidis
ccattacactccagcctgaggtgacacagcgagaccctgtctcaagacgaaaaaagttctacttgcaacactccacacaactagtgcaattcttggtatgtcaaaataccaagaatgagaactgctgatacaaaatacagtggaacacaaagaaaatgtccctttgtatctgggaaaggaggcaggggtcaggaaaagctttaaagagaaagtgatgcttcagctgtctttaaacagtaacacagttgagtcttttctggaagttctgcttcttacagaaggaaaagtatgtattcagaaaactgaaaaatgttcagtatggctggcatgtatagtgaccaagccaacagataataaatctggggaacaaagaagcaccaaatagaccatggagggccttgtaaaccagatctgtaactagagagatctggaagtgtgggaaatagactcaatgaaggaacaaccatgtgcttagagagaaccagggaaagctccatgaaagatggagcccagccaagagtggacatgataagtttggagcatctatgatgattctgggtaaatgcatctaacagacagttaagaaccaagtctaggccgggtgcagtggctcacgtctataatcccagcac

SEQ ID NO: 38028 - DNA, 699 bp, Neisseria meningitidis
  misc_feature (587)..(587): N is any nucleotide
ccgaacagtctctgactcaaagtaagggcagtaattgtcatctgttgtttttgttccagctgactgtgctgtatcatttctcactcacatttaagtccactgttcttatcactgtagtaattaccctgacagattacccatgttttttttttacatgctgatttcagtggactttttttgagacaaagtctccttcttgtcacccaggctggagtgcagtggtgtgatatgggctccctgcaacctttgcctcctgggttcaagcaattctcctgcctcagcctcccaaatagctgagattacaggcacccgccaccatgcctggttaatttttttatttttagtagaaacggggtttcaccatgttggccaggctggtcttgaactcctgacctcaggtgacctgcctgcctcggcctcccaaagtgctgggattacaagtgtgagccactgagcccagcctcagtggacttacttttttaagccttgtattccttgtatcagccgacactgttggccacccacttcttaaaacttcagtgtttctgatcctcctgtcttctgatcctttaatctctctctttttntttttttttttttttttgctctgtcgcccaggctggagtgcaatgacgcaatcttggctcactgcaagctccacctcccgagttcaagtgattctcctacctcagcctcccg

SEQ ID NO: 38029 - DNA, 693 bp, Neisseria meningitidis
ccttgccttttaggaagaaataatagatggaagctatctgaatggtaatgtgcccccttgatctccacttgcttcttctaagaatttcaaacagaatgtagctgtgatctctctggaatgattccttttaaagatgtcttttcattttactcccattgtagcactgctggatctcatacagtttcaaaggtaaaatgccctagaggagaggggaagggatggtatagatttttaataaaaattcttaatggaagtctcttaattgtaaaaagtaatatgtgctcattacaaaaaatgtcaatcaatgcacaatgtgttaaaagtcaacaaacacccttgctccacgggcatcattcctcctcactctagcataagggccaattttttttctttttttgaatggagtttcgctcttgttgcccaggatggagtgcagtggtgctatcttggctcactactgcaacctctgcctccggggttcaagcaattttcctgcctcagcctcctgagtagctggggtaacaggtacctgtcaccatgcccggctaatttttgtatttttagtagagatgggttttcaccatgttggccaggctggtctcaaactcctgacctcaggtgatctgccggcctcagcctcccaaagtgctgggattacaggtgtgagccaccgcaaccggcctaagagctgaa

SEQ ID NO: 38030 - DNA, 587 bp, Neisseria meningitidis
gtaccctgtctaaatttgccgtccgttgaggtagaaggcaaatttggagttttcttgtttagaaaaaaaactacagatgactactgtgcacctgaaaacagcactcagcttcactaacgagacatgcaagctagaatcaaattgctgttttgttttgttgcctgtcgtgattgttagctgaaaccaaatcacaaggtctttttctccctctgtattagctcagcatacactgagcttacaaacgtatgaacttcacgttgtcgtggaatcttacagcctgctacttcctaagtatcctttagagaagctgccttggtgaccaatgaatgtggttagcctagtgatactcttctgggccatatactgtgtgactatctgcatggacctttattgaaagcatttctgcaaataatttttttaagtgttttttaaatgtgtgataatttgtgcttttaaagatatcttacacttttcacttatttgtacctttaaaaatcttttttttttttaaaccaaaggtttgcagtatcctcagagtctgaaatttgagcggatagtgatgagccagccaaatcccctgaagattt

SEQ ID NO: 38031 - DNA, 695 bp, Neisseria meningitidis
ccagttcgagaccagtctggctaacgtggtgaaacccatccctactaaaaatacaaaattagccaggtgtggtggcgcatgctgctaatctcagctccttgggaggctgaggcaggagaatcacttgaacccgggaggtggaggttgcagtgagccaagatcgcaccactacaccccagcctaggaaaaaagagtgaaatttcatctcaaaaaataaaataaaataaatatgacagtaatctctgtttattaaacacataatgtgccaggtactattgtggtcaccctgcaaagacatggaccccaccacccaaaatttgttttagatgtcaagactgatgatacaccacatgcaccaagagggtaggaaaaggtttattgctcatataatgaagctttctgagagagcagggcagattcccaagcaggtccaaaaatggtttcagaaaaccaggcaaggaaactcccttagcatttatggtggttagggatggggatggggatggggatgcgatggggatggggatgaaatgtgggtctggtgggagggctagggcttgttgggtatgaatttccagctggtgccagaggagagagcagcaggctttcttagcttgcccagatgtggggcagagggggagaaggagggtggaagatgttagcagtcccatatcagaagtggaggcagactgttt

SEQ ID NO: 38032 - DNA, 683 bp, Neisseria meningitidis
ccgaatgaagtaatctcttcattgtatttttttttttttttacttatgctgagatttaaatgacaaagattcatataatccaagagagaagtattatttagagggattcttttaccatgtgatatataataaatgcatccaatgttatacatcaatttaaaaaacaagtaaataactttaaagaaaagataactactggccaggtgcagtggctcacacctgtattcccagcactttgggaggccaaggcaggtggatcatgaggtcaggagttggagaccagcctggccaagatggtgaaacctgtttctactaaaaatacaaaaattagccgagcgtggtggcaggcgcctgtaatcccagttactcagtagctgaggcaggagaatcgcttgaacccgggaggcggaggttgcagtgagttgagatcatgccactgcaatctagcctgggtgacagagcaaaactttgtctcaaaacaaaaagaaaagaaaagataagataattactttatacttagcttgtcttacccatgagtgacgggctgcatgtggcccaggacagttttgaatgcagttcaacacaaatttgtaaactttcttaaaacattaggagattttggccaggtacagtggctcatgcgtgtaatcccagcactttgggaggctgaggcgggcagatta

SEQ ID NO: 38033 - DNA, 701 bp, Neisseria meningitidis
  misc_feature (3)..(3): N is any nucleotide
ccntgtcgcccagactggagtggagtagcatgaccataactcactgcattgcggaactcccatgctcatgtgatcctcctgtctcagcctcctgagtagctgggaccacagacatgcatcaccatgcctggctaattttttaactttttgtagagacaggatcttgcttgctatgttgcccaggctggtctcgaactcctggcgtcaagcgatcctcctgcctcagcctgtccaaattcttaacactatactattctgcctcctatactaatcccacagaaataaatttcttttatcaaattaaccttaaaacagaccattcattctcacaagacagatagtcagaaatacaggatcgatctgtgtttcatggtaatacctggctccttccaagttccttatccttcaggactgtagagttgaatccaggttgcctccttaaatcaaagagagacacttccttaaagaaagccccttgtatctccacgatgcctggggcagtgtcttccgcttggaccatctgccagaagcgagaagcaacaaaacaacattgtaaaaaatgcattgagctttgaggaagggccaggcactacatcacaggcaataaaatccatcagaaccgctcagcaaccctaggaagtggagagtagcatcatccccatttcacaggtgagggaacagagacttaaagtgtgatgagt

SEQ ID NO: 38034 - DNA, 776 bp, Neisseria meningitidis
gtaccccatgggtacagaggaaaagcaaagaaaggaaggataaggatgggtgcgtaggaagacaaccttccaattacaaggcagagtagctctgaccttctaggaacaggtgagcccctaagaacgtcccaagggatggaaagcaggttctcctaaccatctcaaaggcacccctcttagggtgattggccaaataggacatgttcaccaacacgtctcaagagaaagacagtctggtggacttcagtattccctgatgcatccagtcaagtcctatgggtgaataattttgttcttggggaagggtttcaacagcatccttgtccaaagatatcttcatgggccactgaaagaaactggcctcctagataggtctattacctttaaaagggtttttcttcagctttaacagatacaatagatttggaatgcaaatgaaaaaaatgacaaacctacaaaaagaatcaaaacagtatacaacactgtcctctatccacaaaacaaatggatctttaagtgcaaccacacaaaagagatgacaaaagccttacatacagggttttatatataamamaggagacactttattctaaaatcaccacttagaaatataaacatcttgcacagagtaggaattttattcactttaaaaacatgccaaaaacatatgggagatatttctgacttgagacaatgctatactcttttttaagcatgatattaaaagtactcggcaaattaggctacttacataagagaaataaatttagctcttg

SEQ ID NO: 38035 - DNA, 523 bp, Neisseria meningitidis
cctgcactccagcctgggcaacaagggagaaactgtctcaaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggctgaggcaggcagatcacgaggtcaagagatggagactatcctggcgaacatggtgaaaccccatctctactaaaaacacaaaaattagccaggcgtggtggtctactaaaaatacaaaaattagccaggcgttgtaatctgagctactcaggaggctgaggcaggacaattgcttgaaccccagaagcggaggttgcagtgagccgagatcttgccactgcactccagcctgggcgacagagtgagactctgtctaaaaaaaaaaaaaaaaaaaaaaaagtcatcaaaccagatgacacaaatccaatggcatttcactttggtttgg

SEQ ID NO: 38036 - DNA, 598 bp, Neisseria meningitidis
ctgcatgactccgccaaaatctatcgcttcccggtttcgcagagcattgatgagctgatggaagcttgtcgtgacgtgatccgcaaaaacaatctcaccagcgcctatatccgtccgctgatcttcgtcggtgatgttggcatgggagtaaacccgccagcgggatactcaaccgacgtgattatcgctgctttcccgtggggagcgtatctgggcgcagaagcgctggagcaggggatcgatgcgatggtttcctcctggaaccgcgcagacctaaacaccatcccgacggcggcaaaagccggtggtaactacctctcttccctgctggtgggtagcgaacgcgccgccacggttatcaggaaggtatcgcgctggatgtgaacggttatatctctgaaggcgcaggcgaaaacctgtttgaagtgaaagatggtgtgctgttcaccccaccgttcacctcctccgcgctgccgggtattacccgtgatgccatcatcaaactggcgaaagagctgggaattgaagtacgtgagcaggtgctgtcgcgcgaatccctgtacctggcggatgaagtgtttatgtccggtaaggcggc

SEQ ID NO: 38037 - DNA, 616 bp, Neisseria meningitidis
gttgccaggctggcataagcacgcaggcaaaggagacctgacgttcacgatttttcggcgtccaggctttgtcacctcgagcgtcctgcgcttcacgacgcgccgccagttcggcatcgcttacctgtaactgaatgccacggttcgggatgtcgatagcgatcaggtcaccatcttcaatcaggccaatgctgccgccgcttgccgcttccggtgagacgtggccgatggaaagaccagaggtgccaccagagaaacgaccgtcggtgatcagcgcacaggctttgccgagacccattgatttcaggaagctggttgggtagagcatttcctgcatccccggaccgcctttcgggccttcatagcgaattactaccacatctccggcgacaactttaccgccgagaatcgcttctaccgcatcgtcctggctttcgtacactttcgccgggccggtgaatttgaggatgctgtcatcgacgcctgccgttttcacgatgcagccgttttccgcaaagttaccgtagagcaccgccaagccgccgtctttgctgtaggcgtgttccagcgagcggatacagccattggcgcgatcgtcgtccagcgtatcccaacg

SEQ ID NO: 38038 - DNA, 4918 bp, Neisseria meningitidis
gggggatgaaaaccagctcccgtccgtcggaataggggcggtgctgtccgttttgtcacaaaaaaccgttttggacggagaaacgcaccaaaggctggccggcttccttccggaacacagtttcagcgtcacgcaaatccacccgtgttggcgcaaaacaccgcccatctgtcgttcagccaccgcttcggcgacaacagcggcatcggctgccttgcccgtgccgccgtatcgggcgatgaaggggcgtgggcattgtttgaccggtttccggacgaactggaacattcggaatgcagtccgaacgctcgagtcgaaaggttgtaccgggcacacaaagcctattggcaggcggtaaaagacggcaatatcgaagccgcatacgcgggcatttcggatatcgtggttctggcagcttggcggcaggatgcggaagacttcaacgaagcctattgccgccatgtacgccgcaaaatgaacataccggaacatttggcatattttgccggagagccgattatgatcaggcagaacgactacgcgcttgaactgttcaacggcgacatcggactgattatggaagatgtcggacggcagggcagccttgccgcctattttgccgatgcggacggatttaaaaaggtagcggtaagctgcctgcccgaatttgaacccgcattcgccatgaccgtccacaaaagccaaggttcggaataccgggaagtatggctgctgccgccttccgccgcaccttcggacgaaggggacgatgcattgtccggattgagtaaggagctgttatataccgccattacccgcgcgagagagaagttcgtattcttcggcggggaagaagccttccggcaagctgccgccaccgtcaaaacgcgtcagacggcattgggcagtatgctcgagcgggtattttcacaagaataatccgcccgaatgccgcgccgccgccccttatgcctttttcaaacggtataggaaagtggtttcccgggttcgcgcaaaagcaagcggatcgctcggattcgcggcttttttgtgcttcggcttggttttcatcatatcggcaacacgcaaacccgcctgagcaaatgccttatccagaaaatcggatggacgcaggtgcagatgttcggcaagatcggaaatgatcaggcggatttctccgtcgggattcagatgtttcggcgcatcccgcaaaaacgcagccagcatcgcagattcggggtcgtataacgcggattcgacggcggaagtcggcttggcgggaagccagggcggattgcagacaatcagatcggcaaacccttcgggaaacagatcggtttcccgtatctcaacctgtttttcaaagcccaaacgggcaatattggcacgggcgcaggcgacggctttcggattggtatccgtgccgatgacggaaggaatgccctgtttcgccaaaatggcggcaagcacgccggagcctgtcccgatatcgaatgccgtctgaaaacccgttgacggcgcatgggcgagcaggtcgaggtattcgccgcgcaacggcgagaatacgccgaaaggaacgtgtatgctgccgcccagctgcggaacggcaacccctttcttatgccactcgtgcgcacccataaaccccagcagcagattgagcggcaggaaaaacggtttgccgtccgcctctccgtacacgtcgagcaaagcggagcgtatatcgggcgcgcgtttgttgtccaacacaaaaccggggcggatttcaacggcaagcatattcagaatacggctctgctgcgcctgcttcatacggtgggcatggaaaagggcggcgatatccgcatcggaacggacggcggcaggtttgcgaaccctcttcttcattgcagaaagcacctgtttggcattgtggaaatcgccctgctagacagttgcaatattttgataggcagccttcaaaatgccgtctgcaccgctttcgcggacataatgccaacctttgggcggcttttgcagactttcgttgcgccattcgaacccgtcatcgggaaaaataaaagaagacatgggatacctgcgtcatgttttgaaaatagggcggcagaaccgcaaaccatacggatggtacagcaaggagcggcaacacagaacagttttttgttcccgccttgtctttccaagcccatgccgtctgaagccggaatgtttcagacggcatcgcatcaaactccataaataaaccacatatgcttgaaataataccttcaaccccaatgtacgcgaaaatcggcaatctgtcagacacaagagagtacctatgacacaaaaagaaaagcattttgaggaatatgccgccttggcaacccttcctttgcgggatgtcgtcgtttacccgcatatggttctgccgctgtttgtcggcagaccgaaatccatcgccgcactggaaaacgccattacccgcgaggagccggttttcctgttggcgcaaaccgatgcggcggtagaagaaccgattgccgccgacctgtatcagaccggtacggtcgcacaagtcctgcaagtgttgaaactacccgacggcacggtaaaagtattggtcgaagggctgtatcgcggacgtgttctgaccattgaagacacgggcggtctgttcgtttcccatatagagacggtcgtggaagaagacacgggcggcaataccgacctcgaagccgtgcgccgcaccctgttggcgcagtttgaacaatacgccaaactcaataaaaaaatccccgccgaaattatcggcagcatcaacggcattgccgaaaacagccggctaaccgatacggtcgcagcgcatttgcagttgaaactggcgcaacgccaacagattttggaaattcccgaaatcggcaaacggatggaattcctgctggcacagctggaatccgaactcgacattatgcaggccgaaaaacgcatacgcggacgcgtcaaacgccaaatggaaaaatcccagcgcgaatattatctgaacgaacagattaaagcgatacacaaagaactgggcgaagaagacgaaaacggcgaactggatgccttggaagcagatatcaaaaaggcgggtatgaccaaagaagcggaagaaaaatgcctgtccgaactgaaaaagctcaaaatgatgccaccgatgtctgcggaatccaccgtcgtacgcaactacatcgacactttgctcgagctgccgtggaagaaaaaatcccgcgtcagcaaagacatcgccaaagccggactggtgctggatgccgaccactacggcctggaaaaagtcaaagaacggattttggaatacctcgccgtccaaaaacgtatggacaaactcaaaggcccgattctgtgcctggtcggccctccgggcgtgggcaaaacctctttgggcgaatccatcgccaaagcaacggggcggaaatatgtccgcatggctttgggcggcgtgcgcgacgaaagcgaaatcaggggacaccgccgcacctatatcggctctatgcccggtaagattttgcagaatatggcaaaagccggcgtgaaaaaccccttgttcctgctcgacgaaatcgacaaattgggtaacgacttccgaggcgatcccgccagcgcgttgctcgaagtgctcgatcccgaacaaaacaacaagtttgccgatcattatgcggaagtggattacgatttgagtgatgtgatgtttatcgccacatccaatagtctgaatattccgactccgttgctcgaccgtatggaaatcatccgtctgtccggctataccgaagacgaaaaaatcaatatcgcgatgcagtacctcgtaccgaagcaaatgaagcgcaacggtgtaaaagaaggggaattggcaatcgaagaaagcgcggtgcgcgatattatccgttattacacccgagaggcgggcgtgcgttcgctcgaccgcgaaattgccaaaatctgccgcaaggtggtgatgcagattaccttggacgaagataagaagaggttgtctgaaaccaagaaaaccagcaaagccaaacctaaagcggttaaagtaaatgagaaaaatctgcacgactatttgggtgtgcgccgcttcgattacggcgttgccgaaagcgaaaaccgtatcgggcaggttaccggtttggcgtggacggaagtcggcggcgaattgctgaccgtcgaagccgcagcattgccgggtaagggcgtgattcagtgcaccggccagttgggcgatgtgatgaaggaatccgtgtccgcagcgtggtcggttgtccgctcccgtgcggaatcagtgggtttggctcctgatttttacgagaaaaaagacatccacatccacgttcccgaaggcgcgacgccgaaagacggccctagtgcgggtattgcgatgaccttggcggcggtatctgcctttaccaaaatcccggtacgcgccgatgtggcgatgacgggcgaaattaccctgcgcggcgaagttttgcccatcggcggtttgaaggaaaaactgttggccgccttgcgcggcggcatcaaacacgtcctgattccgaaagacaacgtcaaagacttggaagaaatccctgaaaacgtgaaaaccggcctgaccatccatccggtcaaatggatagacgaggtattggctctgggtttggaaagccagcctgagccttgggcagaaccttctggtgcggaagcggcggcggaatccgcttcaaaaccaaaaccccgcagcagggcaaccaaacattgaaacgcaggaaatgtgttgtaaaaatgcggtttcgtcctgaaagcctgtcaaatagggtgattccgtattttttgcttgacacggcaatttcagaattgctataaagcgaaagttgctcaagcagtacaaacccgg

SEQ ID NO: 38039 - DNA, 766 bp, Neisseria meningitidis
aaaatcccgtcattcccgcgcagcgggaatctagacattcaatgctaaggcaatttatcgggaatgactgaaactcaaaaaactggattcccactttcgtgggaatgacggaatgtaggttcgtgggaatgacgggatgcaggtttccgtatggatggattcgtcattcccgcgcaggcgggaatctagacattcaatgctaagacaatttatcgggaatgactgaaactcaaaaaactggattcccactttcgtgggaatgacgagtggaagttacccgaaacttaaaacaagcgaaaccgaacgaactagattcccactttcgtgggaatgacgyggwgcaggyttcygtatggatggattcgtcattcccgcgcagcgaaatctagacattcaatgctaaggcaatttatcggaaatgactgaaactcaaaaaactggattcccactttcgtgggaatgacgcgattagagtttcaaaatttattctaaatagctgaaactcaacgcactggattcccgcctgctcggaatgacgagtagaagttacccgaaacttaaaacaagcgaaaccgaacgaactggattcccgctttcatgggaatgacgggatgcaggttcgtaggaattacgtggtgcaggtttccgtacggatggattcgtcattcccgctcaggcgggaatctagacattcaatgctaaggcaatttatcggaaatgactgaaactcaaaaaactggattcccactttcgtaggaatgacggc

SEQ ID NO: 38040 - DNA, 546 bp, Neisseria meningitidis
ccaaagaagtgacggagttgatgtgcacaggactatgtaaaacgggcttgccgtttaacccatacaaagaagaaagccaagggcaggaagttcagcaaagcgcgcacaacattcggacagggcgcaagttgccacattgggcggaaaaccgtagcagaacctaatgtacgataattgggaagaacgcgggaaaccgtttgaaggaatcggacgggggcgtggtcggatcggcaaactgaagaaaacggcaagagagaaaaaagacccgtaaaccgtttgaatatagacggtttacgggtctttgtttcgcgcaaagcaagggctaaggcagtcaggcagcaaatcccgcaatgtattaaaacagacgcgtagaaatgccggctgcctggagcgtttttctttattgaatatcatcctagccgtatcaaggctgtatgaatatgttttttaccaatgaatataatcgggctggacatctcaaaggacaccatagacgcaacattgcataaaacaaacggaagtatccattacattaaatttaagaat

SEQ ID NO: 38041 - DNA, 642 bp, Neisseria meningitidis
tttacctgctcttttaattgcagcttcatcaattcgatgacaccttgacggtgtgcctgctctgcggcttctgtggtatcaaacaggcgcagggcgatgcggccgtctttttctttttgtaggccgagatagccggtgagctgttgtttgccgcgtgcgaatttgatggattcgggcagggtgccgatgtcccatgcggtgacgttgtcgcgctcaaattcttgggtgttgtcacggaaggtaacggcggcagcttgaccgagttgttgttgcaattcgtgcagtttgcggccgccggcaagctcttgtccgccgtcgtcgataatgcggaggttgaaatagcagtgttcgggcagcctgaacgcggcccattcgtcttggttgatttgctcgaatatgcggatgtcgcctgcggttttggcgatggcttgggcgagttggggcaggatgggggcgttgcggtcgggcattcgctttcgttccaccgtattcaaaataccgatgaaggggcgatgattgtcaaccacaatcaagacaaagaatccaccgttaccattacaggcaataaagatattgctacaaccggcaataacaacagcttggatagcaaaaaagaaattgcctacaacggttggtttggcg

SEQ ID NO: 38042 - DNA, 9133 bp, Neisseria meningitidis
cattaaaaataagtttttccttaatttttcttagtgcttgtttttatctgcttatttgttgcaatgccgtctgaagcaatgtgcgtttcagacggcatttggaatttcagttgggcagggtatcggacggtacggtttccggctcttcttcatccgtaggcggcatttctatcaaatcgggcaaaaccagttcgcccagttcggtcagcggcggcagttcttccaagctgttcaaacccaaatcgctgaggaacgttgccgttgtcgcccacaatgcgggttttcccaatgtgtcccgatgtccgatgacttcaatccacccccgatcctgcaagtctgcatcacgttctgcgacaccgccacgccgcgtatgccctcgatgtcgccgcgcgttacgggctgctggtaggcgataatcgccagtgtttccatcacggcgcgggagtagcgcggcgcacgctgttcttgcaggctgcccagccgctcgaatgccgtctgaacaatctgaaaacgccagccctcttgcgtatgcaccagttgcaacgccctatcctgccaacgcgttttcaactgcgccaacacatcaatcagtttgtcttgcgacaacggcggcacacacagttcgcgcatagatttttcggtcagcggttcggtttgggtcagcagtgcggcttcaatcagcgcgtcgggagaaattttgtcggtcatacgggtatccgtgctgaaacggcatgggtttggatatgccgtctgaaatcggttggagtagagagaagctgcctgaaaaatatttttcagacggcattctttatgcttccgaagcttctgccctttacgctctgcttttctggcttcgcgtatggctttgagttcggcttctttctgacgggcttttttgagccaagtttcccattggttcggcgtttcgagggtgattctgccgattttgccttcacggaagtcggtgaggatgttttcggcggctttttggtagttgatccgtccgccgctgaggactgcgccgcgttttttggctatccattcgagccaaacgttttcgtcccagtggctgctggggtctttgtcggcttggtagcgttcttgcaacatagggaggtagtggcggcggaggtagtctaaaagttcgagggcgacttcttcttcgtccaacgcgttgcgtccgactgcgccgccggcggcaaggttgtagccgccttcttcgacgatgattttcggccatagcattccgggggtgtcgtagagccagaagtcatcggcgaggaagaggcgttgttcggctttggtgatgccgggttcgttgccggttttggcggattttttgcctatcatgccgttgatgagggtggacttgccaacgttggggatgccgcagatgaggacgcgcaggggtttatctatgccttggcggtggggaatcatggcacgacaggcttgggtaattttgccgtgtgcgcctgtttcggaggaatcgagggcgatggcgcaggtgtcggggcggctgttatagtgttcgagccagattttggtgcgctcggggtcggcaagatcttgtttgttgaggattttaagtttgggtttacctttggaaagctgggcaagcagggggttttcgctggaggcgggcatacgcgcgtccagcatttcaatcaccatatcaacgctttttgcacgctcggcgatggcttttttcgccttgttcatatggccgggaaaccattggattgccatgtctgttctttcttttcaatatttgaaatgccgtctgaaacggaggacggggtttcagacggcataatggtttgacggaattagcggtctgacaggttttgcgcctgtctgtgccgtatcagcaattcataacgccctttcaaccttcgggcgagtttttcgacaatatagaccgaacggtgctgtcctcccgtgcaaccgatggcgacggtaacgtagctcctgctttcatcctccaaacgcggtaaccaatgcgtaacaaacctttcgatgtcgtcaaccatttcctgcacaagcggctgtccgtccaaataatcccaaacgggcttgtccataccggtgtaaggcctcaactcgggatcgtaatacgggttgggcaggctgcgcatatcgaacataaaatccgcgttgttcggcacaccgtatttgaacccgaaggactccaaaatcaccagcagcccggtacgttcgaccttcagccactgccggactgcatggcggagctgttgggcattcatcttggaagtgtcgatacaataggcgatttctttaagcgggaacagccattcccgttctttctttaagctttccaacaaggtcatatcctgattgctcagaggatgtcctcgcctggtttcggaaaaccggcggaccaacacgctttcttccgcctcgacaaacaaaacttcaaccctgtgccccagtctgcgcagagaggcaatctgttcccgcgcctgtccgatgtcaatgccggaacgcacatcgacgctgaccgccaattcggtttcgtccgcacgttcgatatgatacgacaccagcgcgggcaacatttccaaaggcaaattgtccacgcagaaataacccgaatcttccatttggcgcagtgcgacggacttgcccgaaccggacaggccgctaatcaggacgatcttcattgtgttgttcgttttctttaagttgcgtctgatggcgttccaaaaattcgcgcgtactgtccttaccgcgcaactgcaaaatgtaattgcgtaccgccgcctcaaccaaaacggcgaggttgcgtccgacggcgacgggcagcgtaaccgaacggacgttgacgttgaggatggattcggtttcggtgcggatgctcaaccggtcaagctgcttcatatactcgtcgtccgcctcgactaaattgataatgagttgcaggatttttttggggcggatggaagtttcgccgaaaatatggcggatattgagtatccccaagccgcgcacttccaaaaaatcgcgcagcataggcgaacaacgcccttccagcgtttccgggccgatgcggaacagctcgaccgcatcgtcggcaatcaggctgtggccgcgcgaaatcagttccaatgccaattcgctcttacccaggccggaatgcccggtaatcagcacgccgatttcaaacacatcgagaaatacgccgtgtttgacggacgatgccgccaaggtgcgttgcaggtaaatccgcaacacgtccatcagataggggctttcgagtttggaagtcagcagtggaatatcgtttttatgacaatagtcgcgcagtcccggggaaaccggcaagccgtttgccacaataaccaaagacatagaaatatcgaacaggtcgccaaactgataacccgtttcccccgattcgaggcggttcagatattccgactctgccaaaccgaccacttggatttggttgggatgaatgaaattcaggtgtccgactagggcgaggacgggcttgtccgcctctacgccgatacggttgtccgcacccgaattgccggcggcccaagcgagttgcagtttgtattggttgtcatcaaacaggcggcggacggagatactgggcatattattcttcagtcaggatggcacggacttcttccgcagaggaaaccgtcatcagcgattctctgatgcttttttgggaaaacttgccggccagtttggataagacttccaaatgctcgccggttgcgttttccggaaccagcaagataaaaatcagggaaaccggcttgccgtccggtgcgtcaaatccgacgggttcgcgcgtgcggatgaacgcgcccgtcgcctgcttcacgccggcatgacggccgtgcgggatggcaacgccctgccccaaaccggtcgaaccgagtttttcacgggcaaaaagacattcgaaaacatcagcatgggacaatgaggattcgcgttccaaaagcaggcctgcttcctcaaacagcctttttttactgcctacctccatatccaaaacaatatgggacaaaggcaaaatttcgccgataaggctcataagcttctcttttcagacatcgcaaaacagaaagattgtaccgactgccggggcaaatctcaatcccgcatacggtacgggctgacataacacagcgttttaaaaacatattttaacgcttttcggcacagatagaaatgccgtccaaagcagtttacggctcttcagacggcattgccctgccttatttcgcgaaaaacgtatgggcaaaaatggcggtaaaccacacccaaccaattctgttgtttgccaaaaacgtttcaaaacagatttgccggacgcggcttttgatggcggcatattggcggtattgcagcagcaggacgatggggattgccgtccaatatgcccatgccgcaccgataaccgcacccaatactgccatcagcagggtaaagcctccgtgacacagcataacggcggcgatgtcgtaacgcccgaacgtgacggcggaggttttgatgccgattttcaaatcgtcttctttgtccgccattgcataaaccgtgtcatacgccagagtccataacacattggcggcaaagagtatccacgcttgaggcggcacgtttccggcaacggcggcaaacgccatcgggataccgaaggaaaaggcaagcccgagatagagttggggaatcggaaaaaaacgtttggtaaacgggtaagtcagcgcaagaaacagcgcgggcaggctcatcagccaagtcagatgattcagcggaatcaggcacaatgcggcaagcaggcacaaaaatgccgtcagcagcagcgcttcttttttcttgaccctgccctgtgcgaacggacggttttttgtacgctcgacagcaccgtcaaaatcgcggtcggcaaagtcgttgatgacgcagccggcactgcgcattaaaaacgtgccgattgtaaacgccgccaataccgccaaatcgggaatgccgtctgaagccagccacaatgcccagtaggtcggccacagtaaaagcagcgtcccaatgggcttgtccgcccgcatcaggcgcaggtacacatccaaacggtcggacaggcgtaaaaataaaggggatttaggattcatattgccgcgcagcttgaaaaaacggtattttatccgataaaacgtttcagttcgggcagaaaatactcggtcagcagcatttcctcgccgtgacgggaaaaccgagaacgccgcgcggcaaagtaccgtccgcatccttcgccggcaacggcaaactcaaacgccgaacgcgccccttccaaatcggcttgaaacagacgctcgcccaaaggacgcgtgccgcagtccaaaatgttttgccaaaacgccgaaccgatacggcattcgctccttgcctcaacaacagggatacggtccagcttcaacaaaacttcgcgcaccagcctccctccgcattccgtctccaattcgcccagtttcagcagttccaccgaaaatgtatgcggcaaggcgcgcaatgcggcggtcagcgaccgggtgtgcagcagccgcaccatcggcaggctgatgccgtctgaaatggcggcgggcaagtcgggcagccatttcccaaataggtgttccatatttttcccaatctttataccgcgtctgtttttgccaactccatccattccgcttcggaaaaatcggctttcagacggcatttcaagtagctcaggctgtcttgggcgatgtgtgcgtcgcggctgtcgtggatgtggttgaacacgaggctgtgcaagcgaatgccgtattgtttgagcgcggcgaaactgagtaaagtgtggttgatactgccgagccgtccgctggtaacgaggatgacgggatagccttgctgacggatataatcaatggttaacaggttttccgtcagcggaaccatcaatccgcccgcgccttcgaccaaaacgacttcgtactgcgccgccaattcttgtgtggcggtgcggattttgtccaagtccaaagccctgccatccagtcgggcggcgaggtgaggcgaagcgggatagctgaagatttcgggcatagtcagccgccgtttgtcggcttcctgcatcggtatgcccataattttgcggtggacggcgatgtcgtcggcaatgttttggcaaccggtttgcacgggcttttgcgtaatcacgcttttgccctgctgcaacaattgttttgccaacacgccggtggcgacggttttgccgatgtccgtgtctatgccgctgacgaagtaaacgcctttcatttgctgtgttccttcaagatttgcacggttttgtcggcaagtttggtcaaaacgccgtctgaaatgatatagggcggcatcagatacaccagcctgccgaacgggcgcacccaaatgccctgcgccacgcagtccgcttgaaaacgcgccatatccacgcctttttccagctcgatcaccccgatggcacctaaaacgcgcacgtctttcacgccgcgaatgtcccacgcggctttcagacggccttttaagatgctttcaatgcggcggatatttgcctgccagtcttgagacaaaagcagtttgaccgaagcgcaggcaacggcacacgccagcgggtttgccataaacgtcgggccgtgcataaacacgcccgcttcgccgcgcgaaatcgtttcggtaactttttgcgaagtgattgctgccgccagcgtcatatagccgccgctcaaacccttgccaatacacataatatccggcacgacctccgcgtgttcgcaggcaaacatcttgcccgtgcgcccgaatccagtggcgatttcgtcaaaaatcagcatgatatcaaattcgtcgcacaaatcgtgcaatccgcgaagatactgcggatgataaaaatacatgccgcccgcgccctgcacgaccggctctaaaataaaggcggcaatatccgcatgatgcacttcaaataaggcgcggacaggctgcaaatccgccccgtcccattcatcgtcgaaacggcttttcggattatcgacaaaataacgctgcggcaacgcgctgccgaaaatatggtgcatccccgtttccggatcgcagacggacatcgcgttccaagtatcgccgtgatacccgcggcgcaccgtcgcgatattctgcttcgccgtcaaaccccgcgcctgctggtattgcactgccatcttcagcgcaacttccaccgaaatcgaacccgaatccgcataaaaaatacggttcagcccctgcggcaaaatcccgaccaacaacttgcccagctccaccgctggctcgtgcgtcaaaccaccgaacatcacgtgcgccatttgtttcatctgcgtctcaaccgcctgattcaaaacaggatgattgtagccgtgtatcgcacaccaccaggaggacatcccgtcaatcagccgcgtgccgtccgccaattcgataaacaccccttctgcacgtttgacaggataaacgggcagcggatcggtcatggaagtatagggatgaagcagatgggtacggtcgaaatcaagcaatgatgatatgtgttgatgttcagacggcataagtttctctcttttcttcttactgtattcaaacgcaaaacgcgtattctactccgacagaccgtttcccacacctctccatccgtttcgggcgcaaaaccgcgaaacaaatcgtccgcagtataagcgcacaccgtttcgcattccccaagcccgattggaatcagacggcccaacgcccaataccgtttcacgcagcctccgcccaacgcttcaatcagtcatagatatagtggattaacaaaaatcaggacaaggcaacgaagccgcagacagtacaaatagtacggcaaggcgaggtaacgccgtactggtttaaatttaatccactataaaacggcaatccatacgatacagatcatagcaacagccatcgcaacagcgttagcaaaatcaggggactccgacataggcgcatagcacctaccgatgcacggctcctcattcggctctatgaataccatacccatcacaaaatccaccgccaaaaccaggcacggcttcttatacttatgatagatttccaccatcctgtcccatatataccaaacattcataccgtatatcccgcaggcaacaaattccgattgaaggttacagccctattttatagtggattaacaaaaatcaggacaaggcaacgaagccgcagacagtacaaatagtacggaaccgattcacttggtgcttcagcaccttagagaatcgttctctttgagctaaggcgaggtaacgccgtactggtttttgttaatctactatattttcaaaccggaaaaatgccgtctgaaccttcagacggcattccattcatatttattcgtcttttttgtgttcgatggcgtttcgggaacgattgccgccgtaaggctcttcaaccgtatattctccctcgataatatcgtcatcgcgggaaaagccctcttttctgcccgattggttcatgttgaaaaaattttccgcacctcctgcctgcaacactgcccctcccttaaacggcagcagcagcaataccgccaacaccgaggatacgaatcccggactcatcagacacacagccgccaccgtataacggataggccacaacatctgataaacggataccctcccgccgcttctcattgccgcgcccgccaataaaagaccggacagccccgtatgcctgagcatcagcacgccggcggcaaaacctgccgccatcaaaaacaacgtccagccgccgcccagccaatcggcaacccacacaatcgacataatctccaaaaacagcagcaccaaaaaaccgataccgaaaaatctcattgaccgtcatccttatatttaagtaaacagcaaaccgcccgaacaggactccaagcgagctgcctgtaaatgattacaaaaccatgtgcttcaagccgaaacaatgtgaaatctcgcaatatagtggattaacaaaaaccagtacagcgttgcctcgccttagctcaaagagatcaattctctaaggtgctgaagcaccaagtgaatcggtt

SEQ ID NO: 38043 - DNA, 4891 bp, Neisseria meningitidis
gatgatgatcttcctatagaaataagcctgccaaactgggttccgggcagctatctgattcgggatttttcccgccacatcacttctatccatgcatcctgtaacggcacgtccatgccgctcgaacaaattgccaaaaaccgctggcatgccgccgccgtacgcggcgagtggcaaatccgctacaccgtatatgcattcgatttgtcggttcgaggttctttcctgacgacagaacgcggtttttttgacggatcgtgcctgtttttgaaagtcgaaggaacggaaacgctgccgcaccgcttggaattgacgggtattccgtccgaatggcgtattgccacaacgctgccggaaacagggaggtttgtctttcaggcggcatcttatgccgaattgattgaccgacctgtcgagatgggcttgattgaatttttagattttgaggcggcaggcattccgcacacaattgccttaagcggcatatatcccgatttcgaccgcaacaggctggtttcggatatcaaaaaaatctgcgaaacagaactggcggtgttttcctcccctgccccgtttcaaaaatatttgttcctgctccacgtcggcgaccatatttacggcggtttggaacacaccgacagcaccgccctgctcgccgaccgccacagccttccgccgtacggtatgaccgatgccgacgatacctacaccacattgctcggacttttctcccacgaatattttcacgcgtggaacgtcaaatccatcaaacctgccgcgttcgtcccttatgacctcgacaaagaaaactataccgaacaactatgggcattcgaaggtattacatcctattacgacgatttgtttttggcacgcagccgcaccatctcgcccgaatcttatttaaacctgctggcacaaggcattacgcgcgtacaacaaacccgcggccgtttgaggcagaccttggcggaatcgagttttaccgcgtggaacaaattttacaaaccggatgaaaacagccccaacgccatcgtcagctactaccagaaaggcgcgcttgccgcattgtgccttgatctgataatacgcaaccgaagcaacggcagacattctctcgatacgttaatggacaaactctatcgggagtggagggacacacactcgggtattccggaaaaacactggcaaatccgctgtcaggaaattaccggcttggatttggaagattttttccaaaaagcgttatacagtaccgaagatttgccgcttgccgaatgcctggcaaccgcaggcgtgggactgaccttcctgccgcttccccgacaacacggcggcggatacgcagaacacatctgccccgtcccgtcggcaggcgattttggcgcacgtttcaaacaaaacaccgaccacatcgtcctgacccatgtcttcaacggcggcagcgcggaatctgcggcactgtgcccgcaagacaaaatcattgctttagacggttatgcctgcaccgactttaccgcacaatgggcccgataccacgtcaatgcaaaaatcaatatccacttcttccgtgccggcatattgcgtcaaaccgtcttgacggttcaggcagcggcagcggatactgccatcctacatatcacagaccggaacctgttggacaactggttgttcggttaaactttcagacggcattgcacacaaaatgccgtctgaaaaacaaccgcaaagtaaaggaaacaaaatggccattctgaaacttgacgaacacctctatatttctccgcaactgaccaaagccgatgcggaacaaatcgcgcaactgggcatcaaaaccgtcatctgcaaccgccccgaccgcgaagaagaatcgcaacccgacttcgcccaaatcaaacagtggctggaacaagcaggcgttactggattccatcaccaacccgttaccgcacgcgacatccaaaaacacgatgtcgaaaccttccgccaactcatcggacaagccgaatatcccgtccttgcctattgccggaccggtacgcgctgctccctcctgtggggcttccgccgggcggcagaaggtatgccggttgacgaaatcatccgccgcgcccaagcggcaggcgtaaatttggaaaacttcagagagcggctggacaacgcccgcgtctgattacaagccgaaacgtttaaaccacaccttcaagcggcattccaccgcaacttgaaaaagaggacggcaaaccttactgccgtcctctgtccttctccgtttttacagtgggagacctttgcaaaaatagtctgttaacgaaatttgacgcataaaaatgcgccaaaaaattttcaattgcctaaaaccttcctaatattgagcaaaaagtaggaaaaatcagaaaagttttgcattttgaaaatgagattgagcataaaattttagtaacctatgttattgcaaaggtctcagtgggtatagcggattaacaaaaaccagtacggcgttgcctcgccttaactcaaagagaacgattctctaaggtgctgaagcaccaagtgaatcggttccgtactatttgtactgtctacggcttcgttgccttgtcctgatttttgttaatccactataaaaattagaaatgcacattttcattattctcgcgcaggcaggactccagacttacccatttcagtaatgtttgaaaataaaagaaaaatcagatgtttgtattcccgcctgcgcagaaatggagacggtgctctgtcgtctcatttttgttttaatcaactatatatagctgattaaacataagaaatgccgtctgaaagactttcagacggcattcgttcaagcgtcgaactttattgcgccttggtttcggttacaaaaccgattttggtgattcctgcctgacgggcggcttctaaagctttgtttacataatcgtattccaccgccttgtctgccgcaatcgccacaatcacgttttcattctgctccttggcggctttcagacggctttccacttccccgatttccactttgcttgcagaatccccgccgacataatagccgccgttcgcatcaatcgtcaggcgcagggggtctttaggctgtttgtcctgcttgtttgtctgctcggacgcggtcggcagttccaaagggatggaatgcgtcagcaccggcatagtaatcataaacacaatcagcaacaccagcatcacgtccaccaacggcgtaacgttgatgtcggacatcggagaatcgtcgccggaattcatcgaaccaaatgccataatcagctatccttttgattaagcaggcggacgtgcaaatcgtgcgccatcgcatccaaatcctgggtcagtatttttgtgccgcgattgaggaagttgtatgccaacaccgccggaatcgccacgaacaaacccgccgccgtcgccaccagtgcctcgccaatcgggccggcaaccgccgcaatactcatctgcccgctttgcccgatattgatcagggcgtggtaaatcccccaaaccgtgccgaacagcccgataaacggcgcggtcgcgccgatggaggcaagcgcggtcatcccgtaatcaaaccggcgcataatctgcgccatactgttgcggatttgaatgaccaaatactcgttcaacggcaaagcctgcgccagttcggacgcttcgtttcggcggtagttgcggtaagactgcaatgcctcttgcgccagtttggacaaaggcgcatcgacggcgcgcactttttcgaccgcgtcgttcagcgacaaagtatcgcgcatatgccgtttgacggcggcattccctttgcgcgcccgatacagcttgatgcagcgcaagacaaccaaacaccacgttacgatactcatcaacagcatcaacacaaacacaccaatcaggacgggatcgcccgattcaaacactaatttcaaattcataatgattccaacactgaaaaaaccaatcaaacatccaagctgccgcaaaccgctgcggcaaccgcctaattcaattcaaacttgacggggactttaaactccgtccaggcattggcttgaaaatgcccgttttgcgccgccttgcgtgccgcattgtccaaccgggaaaaaccactgcttttcacgattttaacggactcaacatgaccgcccggagaaaccaaaacgctcaaaacaaccgtaccctgctcgtcattctccatagaaagcgtgggataagccgggcgcggaatgctgccgttggcgcgtaaaggattgcctttgctgctgccggctccttccccgtgttcgcctttgacaccgccgctacctttaccgctgccttctccgcgccccgttccgtctcctttggtaccagttcccttatcttccccattgccctgctcgctgtctgctttggcagaagcattgccgggatgttcggcaggtttttcagacggcttctcgaccggtttttccgccggtttcgggacaggcttcgcttccggcttaggctctggtttcggtttttcttcgggtttcggcttttcttcaggtttcggctcttccttaggctgctgaatatccgcatccgcctttttcgtaaccaccggcttcaaaaccggcttgggcggctcgacaggtttgggcggctcgggcacgggttgcggttcgggcgcagcaggcgcgcctgcaccttcgggggcgccgtcccctccgccaaaatcgcccaaatcgacaaattcaataacattgcctgactctatcacgggcagcttgtgcgcctgccagagcaatgccaccattgccaaatgcagcagtgcgacggaaaacacgactgcgggggttaaaattcgttctttatccataattcgggcataataatagcaggg

SEQ ID NO: 38044 - DNA, 5556 bp, Neisseria meningitidis
acgaccaaggtacgcgcaatctggtggcggcaagtatcgccatcgatatggtcaaagtcctgtcccgcgaaggcgtgaaagatttccacttctatacgcttaaccgcagcgagctgacttacgccatttgccatattttaggcgtgcgcccttaaagccgtatcaaacagtttcagacggcatctaaggtgtctaaaaagcaaaacaccgccccatccgagccattctgatttacaataccggccgattcggattgaaccggtccttacaaaatccaactggagagttcaacatgacaacattacatttctcaggcttcccgcgtgtcggcgccttccgcgaattgaaattcgcacaagaaaaatactggcgcaaagaaatcagcgagcaagaattgctggctgttgctaaagacttgcgcgagaaaaactggaaacaccaggtcgctgccaacgccgatttcgttgccgtaggcgatttcactttctacgaccacatcctcgacctgcaagtcgccaccggcgcgattcccgcccgcttcggcttcgacagccaaaacctgtctttggaacaattcttccaactggcgcgcggtaacaaagaccaattcgctatcgaaatgaccaaatggttcgacaccaactaccactacttggtgcctgaattccacgccgataccgaattcaaagccaatgccaaacactatgttcaacaactgcaagaagcccaagccctcggtctgaaagccaaaccgaccgttgtaggtccgttgactttcctgtgggtgggtaaagaaaaaggcgccgtcgaattcgaccgtctgagcctgttgcctaaactgttgcctgtttacgttgaaatcctgactgctttggttgaagccggtgccgagtggattcaaatcgacgagcctgctttggctgtcgatttgcctaaagaatgggtggaagcctacaaagacgtttacgctactttgagcaaagtaagtgccaaaatcctgttgagcacttacttcggttctgttgccgaacacgccgcattgttgaaagccctgcctgttgacggtctgcacatcgacttggtacgcgcccccgagcaactggacgcgttcgccgactacgacaaagtcctgtctgccggcgtgattgacggccgcaacatttggcgcgccaacctgaacaaagttttggaaactgtcgagcctctgcaagccaaactgggtgaccgtttgtggatttccagctcttgctcgctgctgcacactccatttgacttgtcagttgaagaaaaactgaaagccaacaaacccgacctgtactcttggttggcattcaccctgcaaaaaacccaagaattgcgcgttctgaaagctgcattgaacgaaggccgtgattctgttgccgaagaactcgccgccagccaagctgctgccgactcccgtgccaacagcagcgaaatccatcgtgcagacgttgccaaacgcctggccgatttgcctgccaacgcagaccaacgcaaatctccatttgccgaccgtatcaaagcgcaacaagcatggttgaacctacctctgctaccgactaccaacatcggttctttcccgcaaaccaccgaaatccgccaggcacgctcagccttcaaaaaaggcgaactgtctgccgccgattacgaagccgcgatgaaaaaagaaatcgccttggtggttgaagagcaagaaaaactggacttggacgtactggtacacggcgaagccgagcgtaacgacatggttgaatacttcggcgaattgttgagcggttttgcattcactcaatacggctgggtacaaagctacggctcacgctgcgtgaaaccaccgattatctttggcgacgtaagccgtcctgaagccatgaccgtggcttggtctacttacgcacaaagcctgaccaaacgcccgatgaaaggtatgttgaccggccctgtaaccattctgcaatggtctttcgtccgcaacgacattcctcgctctaccgtgtgcaaacaaatcgcactggctctgaacgacgaagtattggatctggaaaaagccggcatcaaagtcatccaaattgacgaacctgccatccgcgaaggcttgccgctgaaacgcgccgattgggatgcctacctgaactgggcgggcgaatccttccgcctgtcctctgccggttgcgaagacagcacccaaatccacactcatatgtgttactccgagttcaacgatatcctgcctgcgattgctgcaatggatgcggacgtgatcaccatcgagacttcacgttccgacatggaactcttgaccgcgttcggcgaattccaatacccgaacgacatcggcccgggggtttacgacatccacagcccgcgcgtaccgacagaagccgaagtggagcacctgttgcgcaaagccatcgaggttgtaccggttgaacgtctgtgggttaacccggactgcggcctgaaaacacgcggctggaaagaaactctggaacaactccaagtaatgatgaacgtaacccgaaaactgcgtgccgaattggcgaaataagccgagaccgtatgaataaataccgtctgaaagcctttcagacggtattttgtcctgatttgcggcgcaagggcgcagttgccggaaaatcttttcattgcagcttgtttttttctaattcggctttatatgtgggaaacaggcaaatcggagttgtgtttgatagttttaaataatttatattatttgaactataaattatacaaatcattttgcatggggtagaatgcccagcgattcacaattatttctcaaaccaatctattaaggagcttaaaatggctttgcaagatcgtaccggtcaaaaagtaccttccgtagtattccgcacccgcgtcggcgacacttggaaagatgtgtctaccgatgatttgttcaaaggcaaaaaagtagtcgtattctccctgcccggtgcatttaccccgacttgttcttcttcacacctgccgcgttacaacgaattgttcggcgcgttcaaagaaaacggcgttgacgcaatctactgcgtatctgtaaacgatacgttcgtaatgaacgcttgggctgccgaagaagaatccgacaacatctacatgattcctgacggcaacggcgaatttaccgaaggtatgggtatgctggtcggtaaagaagacttgggcttcggtaaacgctcttggcgttactccatgctggttaacgacggcgtggttgaaaaaatgttcatcgaacctgaagaaccgggcgatccgttcaaagtatccgatgcagatactatgctgcaattcgttgctcccgattggaaggctcaagagtctgtggcaattttcactaaaccaggttgccaattctgcgctaaagccaaacaagctttgcaagacaaaggtttgtcttacgaagaaatcgtattgggcaaagatgcaaccgtcacttccgttcgcgccattaccggcaagatgactgcccctcaagtcttcatcggcggtaaatacatcggcggcagcgaagatttggaagcttacttggctaaaaactgatagctgtttgcttaaggcggtttaattaaactgtctgatataccggatagagttattcgggcggttctacactaccgctccgaataactctatatttataagagaatttggatattgttgcactcaatcgaaattttgtttttatttatctgaatgatgtttttgattgggaaaatatttaaatgccgtctgaaaccgatatgttctgtgtcggcaatgtttcagacgaaaacggaaggacaaagattatgaaaaaaattcaagcggatgtcgtcgtaatcggcggcggtactgccggtatgggtgcgtttcgcaatgcccgtttacattcggataatgtttacctgattgaaaacaatgtgttcggcacgacctgcgcgcgcgtgggctgtatgccttccaaactcttgattgccgccgcagaggcgcgtcatcacgcattgcataccgacccgttcggcgtgcatttggacaaagacagcatcgtcgtcaacggtgaagaggtcatgcagcgcgttaaatccgagcgtgaccgttttgtcggctttgtcgttgccgatgtggaagagtggcctgccgacaagcgcattatgggttcggctaaatttatcgacgagcataccgtccaaatcgacgagcatactcaaattacggcaaaaagtttcgtgattgctaccggttcgcgtcccgtcatcctgccgcaatggcagtctttgggcaatcgtttgattatcaacgatgacgttttctcatgggatacgctgcctaagcgcgttgccgtgttcgggccgggtgttatcggtttggaactgggtcaggcattgcaccgtttgggcgtgaaagttgaaattttcggtttgggcggaatcatcggcggcatttccgaccccgtcgtttcagacgaggcgaacgccgtgttcggcgaagaattgaaactgcatctggatgctaaaaccgaggtcaaactcgatgcagacggcaatgtagaagtccattgggagcaggatggcgaaaaaggcgtatttgttgccgaatatatgctggcagccgtgggccgccgtccgaacgttgacaatatcggtttggaaaatatcaatatcgaaaaagatgcgcgcggcgtacctgttgccgacccgctgaccatgcagaccagtattccgcatatcttcatcgcaggcgatgcgtccaaccaactgcctctgctgcatgaagctgccgaccaaggcaagattgccggcgataacgcgggccgctacccgaatatcggcggcggtttgcggcgcagcaccatcggcgtggtgtttaccagtccgcaaatcggctttgtcggtctgaaatacgcgcaggttgccgcgcaataccaagccgacgaatttgtcatcggcgaagtatcgttcaaaaaccaaggccgcagccgcgtgatgctggtgaacaaaggccatatgcgcctgtatgccgaaaaagccaccggccgctttatcggcgcggaaatcgtaggccctgccgccgaacatttggcgcacctgttggcttgggcacatcaaatgaagatgaccgttccgcaaatgctggatatgccgttctaccatcccgttatcgaggaaggtctgcgtaccgcgttgcgcgatgccgatgcgaaattgaaagcctgaccgatatggcaaaacaatgccgtctgaaattttttcagacggcattttgtttttggggatggggtcggatgctgataccgtgtcgggaagggggcggcaaaactaaaaatctttctatttaatctgctgtttccacgcgtgtttgtcaaaatctatcagtttgtttttaaaatacactgttcaaaatgggataaaacaggtaaattaacgtttatgtaacccagtgtagcaatgggtttacggtttttgagtcgatatataactacagaggaattgactatgtctgccaaaccgcgtcctgtttatctggatttgccgg

SEQ ID NO: 38045 - DNA, 12893 bp, Neisseria meningitidis
gcatacacgccttaaccttaatttgcaaaatgaccgtgcctaaacaatgccgtctgaaagtggagattggttttcagacggcatcgcccgagagatgtcggaaatggactttatccccattccttttcggttgaaacccgtctgtttatggcgatagaatctaatcggagggtagtctcgttcgggcaacacgcagtgcggtgcttgatgtgccgtcccctgttgaaacatataaagctcggagaaagtatagtggattaaatttaaaccagtacggcgttgcctcgccttgccgtactatttgtactgtctgcggcttcgtcgccttgtcctgatttaaatttaatccactatatataagggcatcattcctgcaccggcaagaatccgaacccgaacgtttgaaaacaatcccgaatctccgaattcccgcctgtgtgggaatgacgaaaaaacaagcattcatttgccccgaagcagttaatcaaccctttccgccacacacctattccaatatccaatgaaaaccatcacagaaaccctaaatctcgccccgaaaggcaaaaacttcctgaccgccgattggcccgcgcccgccaatgtgaaaaccctgattaccacgcgcaacggcggcgtgagcagaggtgcgtatcagagtttgaacctcggtacgcacgtcggcgacaatcccgaagccgtgcgccgcaaccgcgaaatcgtgcaacagcaggtcggactgcccgttgcctacctcaatcaaatccacagcaccgtcgtcgtcaatgctgccgaagcgttgggaggcacacccgatgcggacgcttccgtagacgacacgggcaaggttgcctgtgccgtgatgaccgcagactgcctgcccgttctattttgcgacagggcgggtacggcggttgccgccgcacacgcgggctggcgcggtttggcgggcggcgtactgcaaaacaccatagccgcaatgaaggttccgcccgtcgaaatgatggcgtatctcggccccgccatcagtgcggatgcgtttgaagtcggacaggatgtgtttgatgcgttctgcacgcccatgcccgaagccgccaccgcatttgaaggcataggcagcggcaaattccttgccgacctttacgcgctcgcccgcctgattctgaagcgcgaaggcgtgggcggcgtatatggcggcacgcattgtacggttttggaacgggatactttcttttcctaccgccgcgacggagcgacagggcgtatggcgagcctgatttggctggacggcaatgccgtctgaacacgccgctgatataatctaccgactttgtgtttttgagaaaggcaagccatgaacaaactgtttcttactgccgcagtgctgatgctgggcgcgtgcggtttccacctgaaaggtgcagacggcatttctccgccgctgacctaccggagctggcacatcgaaggcggacaggcattgcggtttcctttggaaaccgcgctgtatcaggcttcgggcagggtggacgatgctgccggcgcgcagatgaccctgcgtatagacagcgtttcccaaaacaaggaaacctacaccgttacccgtgcggcagtcatcaacgaatatcttttgatattgacggttgaagcgcaggtattgaaacgcggcgagccggtcggtaaaccgatgaccgtgtccgtccgccgcgtccttgcttatgccgacaacgagatcttgggcaaacaggaagaggaagcggcattgtgggcggaaatgcggcaggatgccgccgaacagattgtccgccgcctgacctttctgaaggcggaatgacgtggcggcacatatcggacgcattgatacggacgcgcctttgaaacccctgtacgtcatccacggcgaggaagaactgttgcgtatcgaggcattggacgcattgagggcggcggcgaagaaacaaggttaccttaatcgggaagtttatacggcagacaatgccttcgattggaacgagctgctgcaaaccgcaggcagtgcgggtctgtttgccgatttgaagctgttggaactgcatatccctaacggcaagcccggcaaaaccggcggcgaggcgttgcaggattttgccgcccgattgccggaagatacggtaacgctggttttgctgcccaaactggagaaaacccagctccagtccaaatggtttgccgcattggcggcaaagggggaagtgtgggaagccaaaccggtcggcgcggcggctttgccccaatggatacgcggacggctggacaaaatcggtttgggtatcgaggcagacgcattggcactgtttgctgagcgcgtggaaggcaatctgttggcggcgcgtcaggaaatcgacaagctcgggctgctgtatccgaaagggcataccgtcaatatcgatgaggcgcaaaccgccgttgccaacgtcgcccgcttcgacgcgttccaactggcaggcgcgtggatgaagggcgatgtcctgcgcgtatgcaggcttttggacggattgcgggaagagggcgaagaaccggtgctgttgctgtgggcggttgccgaagacgtgcggacgctgatccggcttgctgccgccctgaagcaggggcagagcatccaatccgtccgcaacagcctcaggctttggggcgacaagcagacgctcgcaccgcttgcggtcaagcggatttccgtcgtccgcctgcttgacgcgctcaaaacctgcgcccaaatcgaccgaatcatcaaaggtgcggaagacggcgacgcatggacggtattcaaacggcttgtcgtgtcgctggcggaataaagcggtaatccccaaaatccgaaaatactgtaaaataccgttaatcctgaaaagtattcaccaatccgtccgaaaacatttcagacggcacgaccacctcaataaaggaacattaaccctatggacaataagaccaaactgcgcttgggcggcctgattttactgaccaccgccgttttaagcctcattatcgtattgattgtcgattcctggccgcttgccatcctgcttgcagccgtcattgtcgctgccgctgcgggcggttttgtttggacatcccgccgacagcaacgccagtttatcgaacgcctgaaaaaattcgacatcgatcccgaaaaaggcagaatcaacgaggcaaacctgcgccgtatgtaccacagcggcggacaacaccagaaagatgcgattaccctgatctgcctgtcgcaaaaatgttcggtggacgaggcgcacgctatgttcaaaaaacgcccgacacgtcaggaaatcaatcaaatggcggcaaaacagtcgcgcggtcagaaacgtccgcaccgttaaccgccgcaaggcatctttgcataaatgccgtctgaagcctgttggcgtttcagacggcatattctgattgaaaagatgatgacactgaaaaccgccccgctcaaacgccgctttgccgccatgctgtacgaaatgctgctggtcggtgcggcaacctgtttggcagcattgattgccggtattgccgccatttttctgaatcccgtttctatcgcggtttctgcattggtaacaagtatcctgataatgggagcatggtggctttatttccgcgccaactggcatggtcaggggcagaccttggcgatgaggacatggaaaatcggcttgtgcgaccttaacggcatacagccgtctttgcacctgctgcgcctgcgctttatttgggcgtgcatatttatcgtatttatccctatgttagcctatgccggattacgccacttcctcggcattccgcccaagggcgcggccggcgcggcattgatttggctgattttaccgtgggggttcgcactgctgaatcccgatcggcagtttctgtatgattttcttgcaggaacaagattggtggcggtcaaaggaaagccttaagcctttataccgcaaaggtttcaacctgaaaaaatgccgtctgaaagggctttcagacggaatttgcttatcggggaaaccgattattcgatattctgcacttgttcccgcatctgctcgattaagactttcagttcgaccgaggcttgggtgcattcggcggcaatggatttgctgcccaaagtgttggcttcgcggtttaattcctgcatcaggaagtccagccgtttgccgctgctgcctttgtgttcggtaacgatacggcgcacttcggcaatgtgggtgcgtagcggctgaactcttcgtcgatgtcggatttttggataaagagggcaaattcctgttgcaggcggtcgttgtcgatgctgccgaccgcttcgacgaggcgggcgcggattttttctttatgtgtttccaacagggtaggaaagagttcgcttaatgcatctatgatttcttccatagcctcaaggcgttgcagcaggtgctcgcctaatttcttaccttcccgcttgcgtgcggcagtaaagtcttttaacgctttttcggtcagttcggtaatgctttttgccaattcttccgtattttccctttggcttgccaatacgccggggaaacgcaggatgtcggcaacgcccagttttgccaaatcgtgatgcttgcggaggtctttgttgatttcggcaagctgtccgaccaagtcgcgattcagttccaaggactgactgccgttttccgcatcttgaatttggattttgcattcgactttgccgcgtgcgatatgggatgaaattttctcgcggataccgctttccaaatagcgcaaatcgtcgggcatcctgatttgaatatctagaaaacggtggttgaccgcacgcaggtcgagattgatgcgtttgctgccgcactctgccgccgcgttggcaaatccggtcatgctgtggatgtggatatttccgctgctcatgtcgttctccgaagcccgttaaaatggaatcaatatatcacatctgtatggcggcaagcgttttcgggtgtgaaaaattgaagattttgcagcggcagattggaatcacgcgcttttgttgctgcaaggaagggaaatgtatagtggattaaccaaaaccagtacggcgttgcctcgccttagctcaaagagaacgattctctaaggtgctgaagcaccaagtgaatcggttccgtacgatttgtactgtctgcggcttcgccgccttgtcctgatttttgttaatccactatatcaattccgccaatctgtcggaaaagcagctgatgcggcagtgtctggtgcatgtctgctttttgatttcggcaattgcaacggcgtggacggataaaatcgtgtacagcacgacgcacaaaccgcattgatgtttaccaaataaaatacccgacaaaacaatttgtcgggtattttattgcgtatatttcaaaccgcttcggcttcttcggtcaggaaaccacgcagtttctgcatggcttttgcttcgatttggcggatgcgttcggcagatacgccgtattcggcggcaagctggtgcagcgtcagcccgccgtcgtcttgaagccagcggctttccacaatacggcggctcctgtcatccagttgcgccaaagcgttttgtaaaccttctgtttgcagggcgtaatgcgcctgtttcgatagttgtcggctcggttcggaatcgtggtcggcaagccagtcgatgggggcgaaactatcctcgtcgtcgctgttgtctgccatgatggcgatgtcgtgtcccgtcattcgctgttccatttccagaacttcggaaagtttgacacccaaatcgtcggcgatgtcttgtgcctctttgggagacagggcgttgaggtttttacgcatgctgcgcaggttgaaaaacagcttgcgttgcggtttggtggtggcaacgcgaaccaaacgccagtttctcaaaataaactcgtggatttcggctttaatccagtgtacggcaaatgaaaacagacgcgcgcctctaccgggctcgtagcgtttgaccgccttcatcagtccgatattgccttcctgaatcaggtctgcctgattcagcccgtagccgtcatagccgcgcgcgatggaaacgacgacgcgcaggtgggacaggatgagttgtttggcggcgttgaggtcgcctttgtgttggcgttcggcaaggcgtgtttcttcctcttgggtcagcatgggaattctgttgacggtgtggatgtattgttcgaggctgccgttgccgctttggatggcgggtaatgcgaaagcgttattcatttgggacatttcctttcggctgaaactgcgtatcggcggtttgctgtgttgggatgcagtatatcactgcttggcttgtattttgtatatttggcaggagatatgcgctaaggtttgaaagacaggaaaaattttgtaaggcaagtttgattgattttgtaaacctgatggctcaattcgattttggaattatattacatacgtggttgtatgtaaatagccgttttgaaaaaagacagcccgtccggacgggctgtgcaggtatcagtgttctttgtttcggaagatgaaaagaatcagtgcggctagggccaatatgcccatcaaccaccatgaactgccggttttcatatagggcgtttcgccgacatagcctttgatgtgtccttccaatacggtttccgtatcgggttgggcttgggcgatgatgttgcctttgggggagatgatggcggttgcgccggtgttggtggcgcggaccatatagcgtccgagttccatagcccgcgcctgcgattgttggaggtgctggtacatggcgttggattttccgtaccacgccatattgctggcattggcaagcagggtggcatcttttgcggcggcaatcagttcgtcgccgaatccgtcttcgtaacagatgttgaaggcgattttttggtttttcatcagcagggcggattgcttgccgccgcctttgcggaagtcggaaaggggcatatccatcattttgtaaagcggcgtggtcaggaaaggcagcggtttgtattcgccgaaggggacgaggtggtttttggcgtagtaggggataccgtcctgattgttttcctgataaccggtcaggttgatgacggcgttttcgtaaccgttgccgtccgaagtgtattggctgatgccgacggcgagcgcgctgccgttgttttgcgcctgttcggcaaatttcgccagtatgttttccggcaggttttggcgcataacggggatggcggtttcgggcaggatgacgatgtcggcggtggttttgccgacttgttcgtaatatttctgtatggtcgggataacttggtcttcacgccatttgagggtttggtcgatgttgccttgaagcagggcgacggtgctgcggctgccgtcggggcgggtgaagtcggtttgtcgggcggtgtagcctgcggcaagcagggcggcaatcaggataatcggaagcaggcgtttgcccgaacgtgcggtgttattactcgccaaaaccagccagacaccgagaaaggcggttgccagtgtaaccatgtggatgccgcccaatggggcaaagccggcgagcgggctgtccggggtgatttgggagtagccgattgcgccccagccgaatccggtcaggaaacgttcgcgggcaaactcggtcagcgtccacaggatgggcagtaccaaaccgatttttatgccccgaggcagggtaaattttttccacagccagaaacacagtgccggataaagggcaaggtaggcggggagtaggaaggtcagcggtacggcatagaggtcgggcaggccggaaacgtcgtgcagggcggtgtgtatccagtagaactgtgtcgtgtatgcggtcaggccgaacaggtaggcggaagagacagcaaaacgcggacgcagttcgatgaggcggacgaaggcaccgaaaatcaagggcatcagccaaaagtggtagtagggtgcgaaggtaaagggggtggcggcggcaaaaaggatgagcaaaggccagtagagggcggggtgctgccagtatttgtccagtttggaaaccatattcatctgtctgttcggaagataccgtctgaacatctttcaaacggcatcggtatttgaaaaaggaatcaatgcctgccgaaacgattcatcagcggcaaggcgggggcgcaggcaatcgaaccggaaagcagcccgacaacgaggttggcgaagtactccgcccagccagcgtcccagtgttgcgcgtgcaggaaatcgtgcagaaggccgaggttgtgggcgaccagtacgccgccgataagaaacatggcaagcgtgccgaccacgctcaaaccgcgcataaagcaaggcataaaggcagtcagcatttgccccaaactgcgcgaaaaggtttgtgggcggcgcatcagcagcatgcctaagtcgtcgagtttgacgatgacggcaacgattccgtacaccaaaacagtcatgccgatgccgattgccgccattacgagcatgcgcgtcatgtcggtgcagaaacttgtgcagcagcttttctacgccttcaaagcacagataaatgccgcctgccgtcaaaagcggcgtaatgagttgcggcaggaaggcggaaagcagcagggccgcaggcaccaaaaccggcttgttggaaaaagaacctttcgccatcgaccaaacaatcggcaactcgcgttctgccgatacgcccgtaacccggttggcattgggtgccaaatcgtcgccgaccacgccggcggttttctttgcggcggctttggtcatcagggcaacatcgtccaaaacggcggtgatgtcgtccggcagggtaaatagtgaggcaaatgccattaaagaatcctgaaatgcggcgcaaagtccgacattatataggagaacgcggatttgggcggtttcaggcggcatgaaacaggaaaatgccgtctgaacgctgtggcggacgtgaagtaaagtttcgtgaaaagaaaataccgtgttacagtctttcgattttaatttcatgaattttaagggagaatcgttagcgtggattggatgggcagtctgttcctgccgggtggcgcactgttgtttctgagcgtggtttcgaccactttgtccgcacgtttgggaatgcctttgctgctggtttctcctgccaacgtgttggacagggcggcggaagccttggcgattgcggcgttcctgatgctggtcgcgcgtccgtcggcagtgttcggcggtttgtggaaattcaattacagcctgcgtgaaaaggcgtatagccgaatagaaatgcagtccgacaccgtgcttcaggcggggatttggcgtggtacatcctgcccgacggcaaggtcgatatagtgaattaacaaaaatcaggacaaggcggcgagccgcagacagtacaaatagtacggaaccgattcacttggtgcttcagcaccttagagaatcgttctctttgagctaaggcgaggcaacgccgtactggtttaaatttagttcactataaaatggcgaaatactttaccgagacgggtattagcgtccgtgagcattttgatttcttcggtgagtttgtcgtttcgccggcagcacgttcgggtgatttggcacttacttacggtttgaggctggaagcgggcgaagagggtttgagccttgccgagcttttcgataagcgttccgatagtcaggagccggtcgagggcggccgtattgacatcggcggctttatgctgaccgcaaaggaggttgacggtggcggcaatatcgggtctatggggctgaaagtgctgcgttagaaaggtttgatttgaatgccgtctgaagccggattgccggtttcagacggcattttgtctgtttagttttttttgctttttgcctgttttacgtctttttcggtaacgcttccgccgccgttgtcaaaggcgttcatgatataagtggcgacggcggcaatgtccgcatcgctgatggcggttgcgggcatgaatccgttgtaggttttgccgttgactttgattgtaccgttgatgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaagcagcccaagacgagggcggtcggcagtcgggttgtgttcattggtgtttccttcatgtttgaaaccttgttgttgattttgcgtagcgggtgaaagatttttttgccgaatcagtagtatagtggattaacaaaaatcaggataaggcgacgaagccgcagacagtacaaatagtacggcaaggcgaggcaacgccgtactggtttaaatttaatccactataaggttgcacttgatgttgttgtccagcatagatgccatcatacgctaaagtagcgggaaaatgccgtctgaacacggcgttcagacggcattttagacatgggtcaaacagtttcaacgccagctgccaaggttttcttcggcaagtgcgacgagtgcatctatccagtcggggttgtcgttgaggcaggggatgtagcggtagcttttgccgcctgcttcataaaactgttcccgccccatcagggcgatttcttccatggtttccaaacagtctgccaaaaagcccgggcaaaatacgtccagctcggttaccccctgtttgggcagtttgccgaacaaatcctgcgtgctcggtgtaacccattttgccctgccgaattggctttggaacgatacgacatattggtcttcggtcagttccagtgcttcggcaagcagtttggcggtgtggcggcactcgtcgggataggggtcgccgaggtcgtggtgcttctgcggtacgccgtgaaaactcaacatcagttttttcccgcgcccgtgttccgcccaatatcggaggatgtggtttttcatcgcatcaatgtagccggtatcgtcataaaagcgcgaaacggtgcggacgctcatttggttccgttgcagcagtaattgttcgcacaccttatctactgccgctccgctgctggaagcggcatattgcgggtacatcgggatgaccagcagtctgcccgcgccttgcgccttcagttccgacaatacgtctgccaccgaaggattgccgtaggtcatggcgtggcggacgatgaggtcgggcatacgtttggcaagcgcggcagcttggcgtgctgtgtaaacttctaagggcgaaccttccttaaaccagattttttcataggcgtgcgcgctttttttggggcggagcgtcagtaccagaccatgcagaatgggataccacagccatttgggcagttcgacgacgcgccggtcggtcagaaaggacttcagataaggtcgtaccgcctgcgcggtcggcgcgtcgggcgtgccgaggttcaacagcaaaacggcggtacggttttgttgcgtataggaaagggagggttctggaaagaatggaagcatgatcggtttctgaaaaatagtgcgggtagggtaaagcggcaaaatgccgtctgaagcggcttcagacggcattgcagggaatcagtctgtgccgcgtgcgcggttttcgtggaatcgcgcctgccagtcggcaaatttgccttgttcgacggcttcgcgcatttccgccataatgacttggtagaaatgcagattgtggatggtgttcaactgtgcgcccaagatttcgccggtgcggtgcagatggtgcaggtaggcgcggctgaagttttggcaggcgtagcaggtgcagctttcgtctatcggacgcttgtcgagcttgtgtttggcgtttttgattttcaaatcgccgaaacgggtaaacagccagccgttgcgtgcattgcgggtgggcatcacgcagtcgaacatatcgatgccgtgtgccacgccgtacacgaggtcttccggcgtgcctacgcccatcaggtaatgcggcttgtgttccggcagaatcggaccgacggcgcgcagcatacggtacatttcgggcttgggttcgccgacggacaaaccgccgacggcaaggccgggaaaatcaaactgttccaaaccgcgcagcgattcttcgcgcaaatcctcatacatcgcgccttgcacgatgccgaacagcgcgttcgggtttttcaaatcttcaaaggcttttttgctccgttccgcccagcgcaggctcatttgcagcgattttcgcgcctgttcgcgcgtcgcctcgcccggcgtgcattcgtccaactgcatcgcgatatccgagttcaaaaccgtttggattttcatggaaatttcaggcgataaaaacagcttgtcgccgttaatcgggcttttgaacgtacagccttcttccgtcagcttgcgcatatccgacaaagaaaaaacctgaaaaccgcccgagtcggtcagaatcggtttgtcccagccgataaaaccgtgcaggccgccgaattgcccgataacttccaaacccggacgcagccacaaatgataagtgttgcccaaaataatttgtgccttgatatcgtgcaggttttgcgggttcatcgccttaaccgaaccgtaagtaccgacaggcataaataccggcgtttcaattttgccgtggttcaactccagcgtgccgcgtcgggcgagaccgtcttttttgtgtaaggtaaatttaagcataagattgaatgtcagttgggcgacaggggtcgaaatatattttaaaagacggcattataaatgatttcccacggtttttcagacgacatcccg

SEQ ID NO: 38046 - DNA, 12077 bp, Neisseria meningitidis
gtattctgggacagccgtagacttacttattatcctaatgttattttttgccaaaagaaaaagtagaaaagacatcattaacatctatttaggacaatttctaggctctgttagtctgatattgctaagtttactttttgcatttgtcttagattatattcctagtaaagagattttaggtttgctcggcttgattccaattctcctaggcatcaaagttttgcttttaggagattctgatggagaggctattgccaaagagggtttgcgcaaagataataaaaacctgatttttctagtcgctatgattacttttgcaagttgtggtgctgacaatattggtgtctttgtcccatattttactaccttaaatttagcgaatttgatagtggctttacttacctttctagtcatgatttatctcttggttttttctgcccaaaaattagcacaagtcccttctgttggagaaactttggaaaaatatagcagatggtttgttgctgttgtttatttaggattggggatatatatcctggttgaaaacaacagttttgatatgctatggactgtgttgggctaggaaaaaatattatgaaaaagatagtatctgcaaagactgccatgtgcagtcttttttgttgccggtctttttgtgtctgatgccgtctgaagcagtctctgcacgacctttgtgcgaatatttgctacacttggcaatccgtccattttttctcacgcttatgctgacctataccccgcccgatgcccgcccgcccgccaaaacccacgaaaagccgtggctgctgctgttgatggcgtttgcctggttgtggcccggcgtgttttcccacgatttgtggaatcctgacgaacctgccgtctataccgccgtcgaagcactggcaggcagccccacccccttggttgcccatctgttcggtcaaaccgatttcggcataccgcccgtgtatctttgggttgccgccgcgttcaaacatttgctgtcgccgtgggctgccgactcatacgatgccgcacgctttgcaggcgtattttttgccgttatcggactgacttcctgcggctttgccggtttcaactttttgggcagacaccacgggcgcagcgtcgtcctgattctcatcggctgtatcgggctgattccagttgcccatttcctcaaccccgctgccgccgcctttgccgccgccggactggtgctgcacggttattctttggctcgccggcgcgtgattgccgcctcttttctgctcggtacgggctggacgctgatgtcgttggcagcagcttatccggcagcatttgccctgatgctgcccttgcccgtactgatgtttttccgtccgtggcaaagcaggcgtttgatgttgacggcagtcgcctcacttgcctttgccctgccgcttatgaccgtttacccgctgctcttggcaaaaacgcagcccgcgctgttcgcgcaatggctcgactatcacgttttcggtacgttcggcggcgtgcggcacgttcagacggcattcagtttgttttactatctgaaaaacctgctttggtttgcattgcccgcgctgccgctggcggtttggacggtttgccgcacgcgcctgttttcgaccgactgggggattttgggcgtcgtctggatgcttgccgttttggtgctgcttgccgtcaatccgcagcgttttcaggataacctcgtctggctgcttccgccgcttgccctgttcggcgcggcgcaactggacagcctgaggcgcggcgcggcggcgtttgtcaactggttcggcattatggcgttcggactgtttgccgtgttcctgtggacgggctttttcgccatgaattacggctggcccgccaagcttgccgaacgcgccgcctatttcagcccgtattatgttcctgatatcgatcccattccgatggcggttgccgtactgttcacacccttgtggctgtgggcgattacccggaaaaacatacgcggcaggcaggcggttaccaactgggcggcaggcgttaccctgacctgggctttgctgatgacgctgttcctgccgtggctggacgcggcgaaaagccacgcgccggtcgtccggagtatggaggcatcgctttccccggaattgaaacgggagctttcagacggcatcgagtgtatcggcataggcggcggcgacctgcacacgcggattgtttggacgcagtacggcacattgccgcaccgcgtcggcgatgtacaatgccgctaccgcatcgtcctcctgccccaaaatgcggatgcgccgcaaggctggcagacggtttggcagggtgcgcgtccgcgcaacaaagacagtaagttcgcactgatacggaaaatcggggaaaatatataaaaaacaacagattgagccgaatttctggattaagtgccggaaatcgcgtataattgcgcgattaaacctttatatagtggattaacaaaaatcaggacaaggcgacgaagccgcagacagtacaaatagtacggaaccgattcactcggtgcttcagcaccttagagaatcgttctctttgagctaaggcgaggcaacgccgtactggtttttgttaatccactataaatcagccgttttgcaggcatcacacaggagcgacaattattatgatgaccctctattccggcattacctgccccttcagccaccgctgccgcttcgttttgtacgaaaaaggtatggattttgaaatcaaagacgtcgatatttacaacaaacccgaagacctcgccgtcatgaatccgtataaccaagttcccgtgctggtcgagcgcgatttggtgctgcacgagtccaatatcatcaacgaatacattgacgaacgcttcccccatccgcagctgatgcccggcgatcccgttatgcgcggtcggggccggctggtgctgtaccgtatggaaaaagaattgttcaaccacgtccaagtgttagaaaaccccgccgccaccaacaaggaacaggcaaaagcgcgcgaagccatcggcaacggtctgaccatgcttgccccttcgttcagcaaaagcaaatacatcctcggcgaagatttttctatgattgatgtcgcccttgctccgctgctgtggcggctcgaccactacgatgtcaaactgggcaaaagtgccgcgccgctgctcaaatacgccgagcgcatcttccagcgcgaagcctttatcgaagcactgacacccgccgaaaaagccatgcgcaaataagtccgaaatgcttgcaaaacccaccgttttgcaggcattttcctattttggcgtacaacacggaacccattatgcccacttccaccaaaccctacatcctccgcgccctctgcgaatggtgcagcgacaacagcctcacaccgcacatccttgtctgggtcaacgaacacacgcgcgtccccatgcagtacgtccgcgacaacgaaattatgctcaacatcggcgcgaccgccacgcaaaaccttcaaatcgacaacgattggatcagcttttccgcccgcttcggcggacaggcgcacgatatatggatacctgtcggacacgtcctcagccttttcgcacgggagaccggagaaggtatggggtttgagttggaagcgtaccgccccgatacgccgcctgaaaacacctctgccgaaaccgcgccccgacccgccaaaaaaggcttgaaattggtcaaataaatctatgccgtctgaacggaatcgtgtttcagacggcattttgtccgatggggcgcaaacggaatctgtttatcggcaaaacccgtttcggcgtatcaaaaccgtgttgcccctgccgattcgatattgggatattgaaaatgccgtctgaacctgcgatacgggcttcagacggcattttgtccgatattcgggcaatcaggcggtcagcacggctttcaggattttgttgacttcgcccatgtcggctttacctgcgaggcgggttttcagcagccccatgactttacccatatccgccatacctgccgcgccggtttcggcaacggcagcttcgacctcggtacggatttcgccggcggaaagcatttggggaaggtagcggtgcagtacctcgatttcggcgttttctttgtctgccaaatcctgacggccggcttcagtgtagattttcgcgctgtcttttcgctgtttgaccattttggtcaggatggcggtgattttggcatcgtcggcttcggtgcgttcgtccacttcaaactgtttgacggcggcgttgatgaggcggatggtgccgagggaaacttggtctttggcgcgcatcgcggttttcatgtcttcggtaaggcggattttcaggctcatgatgtcctcgctgggatgtcggatggaaacggcgggtttcgatgccgtctgaaaagcaaaacacaccgcagagcaggtcttgcggtgtgtcctcatatcacagggctgacctgtaatctgtacttgaacgtttagtacattttgggcggcagttgttggctgcgcaggcgtttttgcaggcgttttacggctgccgcttttttgcgtttgcgttcggtagtcggtttttcgtaggcttcgcgggcgcgcagctcggtcagcaggccggttttttctacggcgcgtttgaaacggcgcatagcgacttcaaatggttcattctcttttacgcggattgcaggcattttatttcctttaataaattcggttgtttcatctgcccatcatatcggtggaaagggtagggcagacggtgttgaaagtttaccgtatcgctgtgccttgcggcggcgggatacgcgccgtgacggaaacatcacctcctaacgggtcggcttgtgccgtgtcaagctgcttgaaaaagcaggaaaaacaattttcggattgtcttatatttatggttcgccgtcaatgccgttcgggataaaaatgccgtctgaaagaccgggcgggtttcagacggcatcggtacgtcagcgtgcaggaacaatgcccatacgctgtttgagcgggatgtgcggcgcgccgaagagggcggcgtagtaggcggcattggccatcacttttttgacatagtcgcgcgtttcggaaaacgggatggtttcggcatataccgcgccttcgaggggcgtgtccgcctgccatcggcgcgccctgccgggaccggcgttatagcctgcggtggcgaggacttcgttgttttgcargcggcgtttggtgtccgccatataccacgtccccatacggatattgccgtcggcggtgtaaagttgtgcggcatccataccgattttgccggcgatttcgcgcgcggtggcaggcataacctgcatcagcccctgcgcgcctacgcgggattgcgcgcctataacgaagcggctttcctgacgaatcagcccataaacccaagccggatcgacattaacattttgcgcgtggcggattaccgtgtctttaaacggcgaaatatagcgcaaggtgtagttgagtttgcggtcggtgcgttccgcgctgttgaccgccatatcgtaaaaaccgtggtcgaacgcggtttgcgcggcggtcagcagcttgtcttcgtcaaagccgcgtgtggcaaaacgccattccgcctgagcctgacggcgcatttttgcatcaccggcagattggctgttttggaacagtaccagtgcgcgtttgactgcaccgtcttccgccatgcggcggacgctgtttttgccggcatcgggcacattgttgcgcgtatcgattttccgacccaattcttcccctgccagcaccgcataaaaattcctgcccgtcgctgccgcctgtttgtaaagtttttccgcctcttgcgtgttgcccgttgcggcgcggctgcgtgccagccagtagagccaggtcgggcttttttgcagtttttcgggcatatgcgagataacggaggccagctcgtcccaacgtcgggcgcgcaaggcggcgcgggcgtaccactcgatttggtcgtcggtcagttggcggcggtcggcaaccttgccgtaatagtccaaggcggcaggcacattgaggttttgcgactgataatgccccaatacgccccacgcgaaactgcgttgttcgaggcttaaaccgctttccatttcggacagcagggcggcggcattcggcgatttgcgtgcttctttgccgatgacgttcaacagggcatattcgcgcgaaccttgtgtaccgccgtcaaacgggctgcccaatgcggcggcaaggttgcgtgcgtctgtggtttggcggccggccagcagtccgcgcacgcgcctccaggcgtcgttgccgtccaacaagccggatgcggctgcctgttccaacagtttggtgcagcccgaaggcagtttgcccgtatttttgaccagttcagcggcacgcgtatagtcgttgcggctcgaatcggcgtagcattcgacttcttgggcgcgccctgccggttcgagtttggcgtattcctgtgcaaacagcgtccactgtctgcgtgcgcccaaagacttcagccactcgttgcggacattttccgccatcgcgctgtcgccggcgttttccaaataggcggcgacggcggcatcgtttttctgtttcactgcatccagtgcggacgggtagccgccgtaatctgccagcgtttttctttcgggttcggcagggcgggtgggaacgcttgccgaaaggtcggcagtttctatattgtctgccggggtcttgccggctggcagtgtgtttgtcgaagaacacgcggcaagcaccagggccgccagcagcggcagggaatgcttcatagagggtaggtacatcggatttccttaagaatcggaaccctgaacggtcagggttggaaaagacaaaatgccgtctgaacaggcgtttgcccgaattatatgccgaaactgcaccgcctttggaatgtttccgacataatttatagtggattaacaaaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatatgtttttcaattatttgccgttttggtgcgaaccgctgcctttgcccgtttcagacggcattgtccgaaatggttgcccgcttcctgctttattgacaaaaaaatgctttcccgataatatcctacgaaaattaacctgccgatttgacacagcttgcgggcataacagctaaagcgttccgacaatttcagctttatcttccgcgcccgttgtgtccgacatcgggctttgttgtatgggaaagacaatgattattttggacaaggtttccaagcattaccaaacgcgcgacaagacccgttttgccgccgtcgagccgaccagcctcgaaatccgcgacggcgaaatcttcgggctgatgggttattcgggtgcaggcaaatccaccctgttgcgcctgattaacctgttggaacgccccgacagcgcaaggtcaacgtctgcgacaagagctgaccgcgctcgatgccgccgcattgcgtcaggctcggcagaatatcggcatggtgtttcagcagtttaatcttttgagcaaccgcaccgttgccgacaatgttgcctttcctttggaaatcgccggatggccgtctgaaaaaatcaaagcgcgcgttaaagaatgccttgaaatcgtcggcttgaccgaacgcgccggccactatcccgcccagctttccggcgggcagaaacaacgtgtcggcatcgcccgcgcactcgcgcccaaaccccaagtcatcctcgcagacgaacccacttccgccctcgaccccgccaccacgcgcagcgtcttggaatgtttggaagacatcaacaaacgcttcaacgtaaccatcgtcatcgtaacccacgaaatgagcgtcatccgccgcctgtgcgaccgcgccgccctcttggataaaggcaaagtcgtcgaaatcgtcgaagtacgcggcaaccaaatccacgcccaatccgacatcgggcgcgaactgattcgggaggactgatatggcagacttaacattccaacaagccgtttccaccawcgtcggcatgaaagacgaaatcttccgcgccttgggcgaaaccttcgtgatggtcggcttgtccaccacattcgccgtcatcttcggcacgctgctgggcgtgctgctcttcgtaacctccagccgccaactgcattacaacaagctggtgaacttcctgctcgacaacctcgtcaacctcatgcgcgccttccccttcgtcatcctgatgattgcgatgatacccgccacacgcgccatcgtcggcagcaccatcggtccggttgccgcctcgctggtgttgagcgtgtcgggattgttttattttgcccgactggtggaacaaaacctgcgcgaagtccccaaaggcgtaattgaagccgccgccgcgatgggtgcgccgccgattgccatcgtctgcaaagtcctcttgaacgaagcgcgcgcgggcatggtttccagcattaccgtgcttgccatcgggcttttgtcatacagcgcggcggcagggatgataggcggcggcggcttgggcgacctcgccatccgctacggctactaccgctaccaaaccgaagtcatcatcttcatcgtcgccctcctcgtgctgctggtcatcctgattcaaagcaccggcaacgcgttggcgcggaaactcgacaaacgttgaacccgaatgccgtctgaacgccaaaacccccaccgctatccgaaaaatgctataaaatccccctgttcgcggcaaatgccgtctgaacgccgaatccggacggcaggactccctgcccgtcatttttgtttgaaactgccacaacatcaggagaaaatatgaaaaccttcttcaaaaccctttccgccgccgcactcgcgctcatcctcgccgcctgcggcggtcaaaaagacagcgcgcccgccgcatccgcttctgccgccgccgacaacggcgcggcgaaaaaagaaatcgtcttcggcacgaccgtcggcgacttcggcgatatggtcaaagaacaaatccaagccgagctggagaaaaaaggctacaccgtcaaactggtcgagtttaccgactatgtacgcccgaatctggcattggctgagggcgagttggacatcaacgtcttccaacacaaaccctatcttgacgacttcaaaaaagaacacaatctggacatcaccgaagtcttccaagtgccgaccgcgcctttgggactgtacccgggcaagctgaaatcgctggaagaagtcaaagacggcagcaccgtatccgcgcccaacgacccgtccaacttcgcccgcgtcttggtgatgctcgacgaactgggttggatcaaactcaaagacggcatcaatccgttgaccgcatccaaagcggacatcgccgagaacctgaaaaacatcaaaatcgtcgagcttgaagccgcgcaactgccgcgtagccgcgccgacgtggattttgccgtcgtcaacggcaactacgccataagcagcggcatgaagctgaccgaagccctgttccaagaaccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaatcccctgccgcatggaatgaaggcgcagccaaataaggcagtcgtataaaatgatgccgtctgaactgtatccgtgttcagacggcatttttgtcctttaatccgccattccctgccattccgccgaatccggcgtatcgattccgaacagcgacaaagcgtgtgcaacactgtgcgccactatgtcgtccgccgtctgcggtttgcggtacatcgcaggaacagggggaaacaccacgccgcccatttccgttacccgcttcatattgtccaaatgggcaaggttcagcggcgtttcgcgcaccatcagcaccagccgccgcctttccttcaaaaccacatccgccgcacgcgtcagcagattgtcgccgaagccgtgcgcgacagaggcaagcgtccgcatcgaacagggggcgaccagcatcccatccgttttaaacgtaccgctggcaatgcacgccccgatattgccgatcggatgcacgaagtccgccaaggcatatacctcgtctctcgcataagccgtttccgaagcgcgcgccatctccgcacctttcgataccacaaggtgcgtttcgacatcttgcgcgcgcaaaagttccaaagccttcacgccgtattggaaaccgctcgccccgctgatgccgattatcaaacgccgtaccatcatccgcctttcccataaaaccgcctgcaacggcaaaccggctattatagtgaaaaaacagaaatccgataaacgcggatacaaattgtcggcaacacccaatatccgataaaatacccgatttaacatcctatctgaataggcacgggagggcggtatggcaaaagtaaaaggcggattggggcgcggcttggattcgctgctcgccaacggcgcggacaacagcagcggcgaccgattgaccacggttgcggttaaagatatccggcccggccgctatcaggcgcgtgttcaaatcgatgacgaagccttgcaggaactggcagattcgattaaggcgcaaggcgtgatacagcccgtcatcgtgcgcgaacacggactgtcccgatacgaactgattgcaggcgaacgccgttggcgcgccgcacagattgccggcctgaccgaaatccccgccgttatcaaaaccatcagcgacgaaaccgcattggcaatgggtttgatcgaaaacctccagcgcgaaaacctcaaccccatcgaagaagcacaaggcttgaaacgccttgccgacgagttcgggctgacccacgaaaccatcgcccaagccgtcggtaaaagccgaagcgcgatttccaacagcctgcgccttttaagcctgcccgaacccgtgcaggaaatgctttaccaacgccgcctcgaaatggggcacgcccgcgcattgctgaccctgcccgtcgtcgaacagctcgaattggcgcaaaaggccgtcaaaaacggctggtcggtgcgcgaagtcgaacgccgcagccaggccgcccttcaaaacaaacgtcccgagcccaaaaagactgccgccgccgacatcggccgcctgaatgatttgctgactgaaaaactgggtgtcaacgctgaagtcaaaaccgccaaccacaaaaaaggcaggattgtcctgtatttcgatacgcctgaaacgttcggccacctgctggagcagttgggcatagattaccggccttaattttgcgggatataccgtctgaaatatagagaatagctttccagattttaagtgggaaatataattctattgacatttttctgcttcacgtaagaatcgttttcctgttttcatttttaattttcgaagaaattatgaacacacgcatcatcgtttcggctgcgttcgttgcgttggcattagcagttgcggctcaatcaataatgtaaccgtttccgactagaaacttcaggaacgtgccgcgtttgccttgggcgtcagcccaaatgccgtaaaaatcagcaaccgcaacaatgaaggcatacgcatcaactttaccgcaactgtgggtaagcgcgtgagccaatgctatgttaccagtgtaatcagcacaatcggcgttaccacttccgatgcaatttgtttgggaggcggaacgcacaaaggcaaaagtcaatgcaatgctttgcttaaagcggcaggcagttgctaatcctttattcggaaaaggtcgtctgaaaatattttcagacgaccttttatttattgagcaaattccccaaactgccgacaatccgaccgataaactgctacaatttcgc

SEQ ID NO: 38047 - DNA, 577 bp, Neisseria meningitidis
ccgaagttggatcgctctagaggatcccctgccgatgtagcgcgctcctggtacgggcataatgccctgggcttcttcctgactgccggcttcttgggtatgatgtactatttcgtacccaaacaagcagcccgccccgtttactcctaccgcctgtccgtcgttcacttctgggcgttgatttttacctatatgtgggcgggtccgcaccatcttcactacactgcgctgcctgactggacgcaatctttgggtatggttctgtctttgattctgttcgcaccctcttggggcggtatgattaacggcatcatgaccttgtccggcgcgtgggacaaactgcgtacagacccgattcctaaaatcccggatggaaccctggtccttctacggaatgtctacctttgaaggcccgatgatgtcgattaaaacggtcaatgcattgagccactatacggactggaccgtcgcgcacgttcatgcgggtgcgttgggctgggtaggctttgtaaccatcggttccgtctattacatgattcccgtctgttcggcaaagaacagatgcacagcaccaagc

SEQ ID NO: 38048 - DNA, 7484 bp, Neisseria meningitidis
ttgaacaggttacgaatttgttgttgaatttgtccacgcggccggtggtatcaacgattttttgggtgccggtatagaacgggtggcacagggagcaaacctcgatattgaagttttctttttccatcgcggatttggttgcgaatttgttgccgcaagagcaggtaacgttgacttcgtggtagttcgggtgaataccttgtttcatttgatttcctttcaaaaaagcgggcataggggatgtacctatgctacagacaagtccgacattctcgctattttctgttgttacgtcaagagtatattcgataaaatgtatagtggattaacaaaaaccagtacagcgttgcctcgccttgccgtactatctgtactgtctgcggcttcgttgccttgtcctaatttttgttaatccactataaaaagttcttttgagggaggtttgatgggatcaaaattctttttcctgctgctgcgttttgccggttcggggttgccgccgtcacatatgcgcggcatcggcatcgtcggcagacgggtgcgcggttttttggcgcggcgggtttctccgcatatcggacgcggggtcaatatcgaacgcggggcgtatgtgtttccggatacggttttgggcgacggctcgggcatcggggcaaactgtgaaatctgccgtgggctggtggtcggcaaaaatgtgatgatggagccggaatgtctgttttattcaaataaccacaagtttgaccgttcaaaaaacgctttgagggctacacggaaatccgtccgattacgttggaggacgatgtctggccggggcacagggtgattgtaatggcgggcgtaaccgtcggacgcggttcggtcgtgggcgcagcgcggtggttacaaaagacattccgccctactctttggcggcaggcaatccggcagtggtgaaaaagaatctgccggaaggttgaatgccgtctgaacgtgtcggggcggatgatctgaaaaaacaggaacatcgtttctgttttttgcgcttcagacggcatcgctattgcgccacgcgcgtatcgatatcttggtagagtttgccgaaatcgggttcgccgacgtaggttttgaggatttcgccttttttgccgataaggacggaagtcggataaacctgtgtgccgaacgcctgtccgacagctttgtccgcatcatacatgacggtaaacggcaaaccgtagtctttgacatattggcggacgctttctatcggatcgatgggctgggcgacggcaagtacttggaagtttttgtttttatagtcatttgccgttttaatgattttgggcatwtcgctcacacaacccggacaggagggaaaccaaaaattaatcagggttactttgccttgcaggtcggcgttggaaacggtttttccgtgcaggtcgggcagggagaaggcgggcgcggttttgctgtcggggatgaggacgatggcaaggaggatgccgatcagtgcgacgacggcggcggtgagtatttttttcattcggacaaggcttccaatgcgcgggcaagggtggcgggcaggctgacggtgcgttgtgtggcggcgtggacgggcatcagggtgatgtcggcttctgcggcggttttgccgtttggcagtgtaatcgtctgggtcagcacaatacggcgcgtgccgggggttttcaggcggcatgaaaactgcaatacgtcgccttcgacggcggggcggctgtatcggatgtcgatgcgggcgacaatcagtatgaggcctgccaactcgtgcagcagtccgcgttcttcaaaaaacgcccagcgcgcttcttcgaaaaattcgaggtagcgcgcattgttgacatggccgtagccgtcgagatggtagttgcggacggtcagcttcatcagttcaggttgatgggttggaaggcttcgcgggcaagcggttcgtgttcgaggtcggtgatgacggtagaaagctggatgtcgaaccattcgttgaaaatgtcggcatcgagcgcaggccactcgcgttcgtcttcgcaccagtcggcaagttcggcggcgaaaatgtcttcaaaacgggcttcgatttcgtcccatacttcgtcggcggtttcgcacgggcggacaaggtaggaattggcgtcggcttggatgtcttcaagagtcagtccgtcgaggtggttgcccggcagggtttgcagccagttccaaaaaggttctaaagggatgaggacgaatacgctgcggttgacttcgtacatggtttttcctttgctgtcgcgcggtatgcgcaaaaaagagattatagcccaatctgtggtttcggactgtccgttccgacagaagggaatgccgtccgaacacggattttcagacggcatggctttaaggttgtgttccaggttgcgtttcggcttcccctgctgcttctgcctgtgtttcggatacggaatcttcttgaacggcagtttccgccgcgccggtttcggcactttcgaccaattcgtcgatgtcgatgttatcttccgtaccttcggcaggtgttgcaccggtctgccgcgcacggactttcatatagaggtcgcgcgtgtagctgtatttgtcgatggcggcttcgtccagactgtcggtcaaatcgagcaggccttcgcgcgtactgacggcggatacggcagtcgtgccccagcgtccgacaggggtgcggaagacgatattcttgggcgaataaacggaggtaatacccgtgccgagcgcgtcgcggacggtggacggccctaagacgggcaacacgaaataattgctgtttttccatccccacgaggcaaacgtgtcgcccaaggtgtttttattgtcgggaatgccgcccgcgccggcgatgtcgataagcccgcccaaaccgaaagtggtgttgatgccgacgcggacaaggtcttcgcttgcgcgtttgatgtccaagcgcaagatattgctgccgaagctgaccacgtcgcacaggttgttaaaaaaattggacacgccggcgcggacgggtttcggcgcaactttgcggtagccgcgcgcggcaggggcgaaaatgtagcggtcggcttggtcgttgaatttgaaaacggcgcggttgtagccttcataagggtcggcggggcgggtttcggcaaatgcaggggcggaagcgaacccgatcagcaggaggaaggcataggcggtttttttcatgatttcagccagtctttgatttcgtacagttcggacagcgcgcgcacggattcgggaatgccggtcagcctgacgctgcctttgcaaccgcgcagcacttcgagcagcagcgacacgcaggcggaatcggcgcgtccgacgccgctcaaatcaaccgcgcaggtgtctttcagacgacattgctgtctgaagcgggtaaaagcggcggcggtcagggttttgacggtgatgtcgccgccgatgtgcaatattccgtttttgagttctgtatgcatagcgtttgctcggaaaacccataccgccctcggacggtatggtttgtcggttatttgccgccgtttttggctttcaactcggcaatcagtccgtccacgcctttcgctttgataatttcgccgaattggttgcggtacacggtaaccaggctcgcgccttcgatggcgacgttgtaggtacggtatttaccgccgctttggtaggtggtgaagtccatgttgacgggtttttgcccgggtacgccgacttcggcgcggacgatgatttctttgccgcctttattgacgatgggattgtctttgacgttgacgttggcgttttttaatttcagcatcgtgccggaataggtgcggatcagcagggtttgaaattctttggccaacgcttgtttttgcgcgtcggacgcggtgcgccaagggttgccgaccgccaatgcggtcatacgttggaaatcgaaatagggaatcgcataggcttcggctttttggcgagcggtgttggcatcgccgttttttaagatgctcaatacttgagtggcgttttgacggatttggcttaccgcgtcggcaggggcggcaaatgccatgccgatgctcaaaataccgatgcccaatgcgctgatgagggaggattttttcatgattaagtgtcctagtttgaatatgatggcatacgtttattcggcggctttttccgcattgccgccgtcggcatttttctcggcaaaactcgtcatgaatttgccgataaggttttccagaaccattgcagaactggttacggagatggtgtcgccggcagcaaggttttccgtgtcgccgccctgctgcagcccgatgtactgctcgcccaaaagtcccgaagtcaggatttgcgcggaaacgtcgctgctgaactgatacttgccgtccaaatcgaggcgcaccctcgcctgataggatttcgggtcaagtccgatagcgccgacgcgcccgaccaatacgcctgcggatttgacgggggcattgaccttcaaaccgccgatgtcgccgaaatcggcataaacggcgtaagttttgtccgaaccgccgaacgccgcaccgccggccacgcggaaagcgagaaaggcaaccgccgccgcgccaatcaggacgaacagtccgacccaaaattccaatatgttctttttcattaaagttccttgaatatccgatgttccgcgtttcgtcttcagacggcctgtcaatctgtaaacatccacgcggtcaatataaaatcgaccgccaaaatcgtcagggcggacgaaaccaccgtgcgcgtgctggcgcgcaaaatgccttccgaagtcgggacgcaatggaagccctgatgcacggcaatcagcgttaccgccacgccgaacgcggcggatttgatcagaccgttgattacatcgtaatgtatcgtgatgttgttctgcatttgcgaccagaaaataccgctgtccaagcccagccaggttacaccaaccaaatacgcaccgaaaatgcccgccacgttgaaaatcgaagccaaaagcggcatggaaaacacgcccgcccaaaagcgcggcgcaaccacgcgggcgacagggtttaccgccatcacattcatcgcttcgagctgttcggtcgttttcatcagaccgatttcgctggtcatcgcaccgcccgcgctgctggcaaacaaaatcgctgccaataccggacccagctcgcgcaatagcgaagccgcgaccatatagcccaaaatatcggcggatttgaatttcgacaactgcgtatagccctgtaaacccaagaccatgccgacaaacagccccgaaacggcaacaatcaacaccgacagcacaccggcgaaatacacttggcgcacgctcaggcgcggacggacgaaagccgtaccggacttcgccagaatgttcagcagaaacagcgtgatactgccgagggattgaataaggccgagggttttcgccccgacggaacggataaagttcataaatttctatgtgtaaagttcaacggtttcagacggcatcaactcatttatcccaacaggtcctgctgcaacgacgtttgcgccggataacggtatgctacggggccgtctgccagcccgccgacaaactggcgcacccaaggcgaatccagttcgcgcatttcctgcggcgagccggagaacataatttcgccgtgcgccaagaaaatcacctgatcgacgatttccaaagatttttcaatgtcgtgcgttaccataatactggtcgaacgcaaagccttgttgacgcggctgatcaagtgggcaatcacgcccaaggaaatcggatcgaggccggtaaacggctcgtcgtacaacataatttcagggtcgagcgcaatcgtgcgggcaagcgcgacgcggcgcgacatcccgccggacaactcggacggcatcaggttttccacaccgcgcagaccgaccgcgttcaatttcaacaaaaccaaatcccgaatcaccgcttccggcaggcgcgtcagttcgcgcatcggaaaagcgatattgtcgaataccgacaaatcagtaaacagcgcgccgtgttggaacaatacgcccatacggcggcggtgttcatacaactcgtcagccgaaaagcccgccaaatcccgtccttcaatcaaaacctgcccggactgcggacgaatctgtcctgtaatcagtcgcatcagcgtggttttgccgctgcccgaaccgcccattacggcagcaaaattgccttgcggaatgctgaaattgatgttcttcagaatcgggcggtcgccatacgcgaaggcgacgtctttcatttcgataaagggggatgggctcatgtacggacggacggtaggtttgacggcgtgtattttaaggcttatcgggaagacgggcaattttcagacggcatacggacggtaaatgttgtgaaaatgccgttgtcggcggcggattgtttgctgtggcgaaaaatgttatctttcaaatgataacctttatcagaaaactatggaaaaagcagaacatttgaacagcagccggttcgtcaatctagtcaaaagcggcggcggcagctatgtggagggcagctaccgtttcgatactttgtccaacggcatttccatccacggcggcacagtaacggcacggtgtgatttttgcagcagccgcctcgccgaaccttatgtgtcgttcgtgctcttgctggaaggcagtttggacttcggcatcaaccgctgccgcttccaaatcgatgcggacggcggcaagattgtcctaattgctgtcggggaagaagtcctgttcagccgctatctttaccgaggcggcaaaacggtcaaaatgaccattaaaggtatggaacaatggctgctgcgtccggaatacgcgcgtttcgcacccctgctttaccgcgaaccggtcaggatatgggatttgcccccgaacctgcgcggcttggcggcatcctgcctgaaagccgtcccaaaggggcatttgggcgaaacattgcgccgcgaggcggacgtgttgcggctgctgtcggacttgtgggacacggtttcagacggcatcgggccggcggcggggcaaacggcggaagcagacgctatgccgtctgaagacttcagccgcaccctaaatgccgcgtttgccgacggcgcacaccaagtcaaccggctgacagacgcgctgaacatcagtgaaaggacgctgcaacgccgtatgcgcgaccatttcggcattacggcaagcgaatggctgcaccacaaacaaatgcagcacgcgctctatctgttgcaaaacgggggaaaaagcataggcgaaaccgcatatttatgcggctaccgccacgtttccagctttactcaggcattcaggcaatatttcggcagcacgcctgcggaaaccaaaaaagaaaaccggtaagccgcatttgatttcaaacccgaaatccgcgtgtatagtggattaacaaa

SEQ ID NO: 38049 - DNA, 4804 bp, Neisseria meningitidis
ctcgcacgtatggttacctcaggcgaggcggacttggcgattgttacggaacggatagacgaccatcccgaactgggaaaacttccctgctatgactggactcatgcggttatcgtaccgaacgaccaccccttgctcgaatgcagaaaccccctccgtattgaagatttggcgaggtttccgctgattacttatgaatttgcattcaatgcgggcagcagcatcgcgcgggcattttccaaagcccgtttggaacaacccgatgtcgcattggctgcggcagatacggacgtattgaagacttatgtgcgcttgggtttgggcgtgggactgatggcgaaaatggcgtacaacccggatacggacggcgatttgcagcttgtggatgcggcacacctgttcgagccgtcgccgacgtggattgctttgcgcagcgatacttatttgcgcggatatgcctacgactttatccaagcgttcgcgccgcacctgacacgcgagaaggtggataggattctgtacacgcccatcagcgaggatttttcgatttaggcggctgccggttttcagacggcactttgcggcagatacaacaaacaggacagatgttttcgtctgccctgtgtttattgagaatgctgtctgaaatgttcgtacgggttaatcaaatggcgtgcgagcagccggacaccatttttttcaacacctgcagattgaggattttgatgtgcttatgctcgacggaaatcaatccttcctgatgaaatttagataatgtgcggctgacggtttcaagtttcagcccgagataactgccgatttcttcgcgggacattcttaagatgaagtcgttggcagcaaaacctcgggaataaaggcgttgggaaaggttcagcaggaaggcggcaatccgctcttcggcgcgcatattgcccaacagcagcataacaccttggtcgcgcacgatttcacggctcatcatgcggaagaagtgcgtacgcaggctggggatgttttgccccagttcttcgatgtgggtaaacggcagttcgcacacttcgctgtcttccaaggcgaccgcgtcgcaactgtgcacatgggaacagatgccgtccatgccgatgagttcgcccgacataaagaaacccgttacctgatcgcggccgtcctgactggcgacggttgttttgaagaagcccgaacggatggcaaagagcgaggtaaaggcttcgccgacacagaacaggtattcgccctttttcaggcggcggctttgacggatgacggcatcgagttggctgagctcgttgggcagcagcccgacaggcaggcagagttcccgcaaagaacaggaagaacacagcgttttcatctgatgtgtagtattatgcgaagccataccgtacctttttgtgcgctttgccccatcatgattatagtggattaaatttaaaccagtacggcgttgcctcgccttgtccttatttaaatttaatccactatatgtgcttattgacacatatcaagacaggtttatcatactgtggcattctaccaaactatccaaaatttgactaacatcataaaaccgcacacacacaccatgaaaatcattcagatacagaacaatcacaatgtaaacgatgaccgccccgagtttgaccgcgcgctgattgccagcctgcccgccagcggcccgcgctacacttcctaccctaccgccgaccgtttccatgacggtttccgcgaaggcgaatatatcaaagctttacatttgcgcggtatgggcgcgttaaacaaaccgctttccctttacattcacattccgttctgcaacaccatctgctactactgcggctgcaacaaaatcatcaccaaagacaaaagccgcgccgatgcctacatcgaatatcttgaaaaagaaatggaactgctcgctccacatctgaacggacggcaccagcttgcccaactgcacttcggcggcggcacgccgacctttttgagcgacgaacagatcgaacgtgtcttccgcatgatacgcaaacatttcgagttaatccccaccggcgaatactccatcgaaatcgacccgcgcaaagtcagccgcgacaccgtcctcatgctcggcagactcggcttcaaccgcatgagcatcggcattcaggatttcgaccccaaagtgcaggcggcggtcaaccgcatccaaagttacgaagaaaccaaagaagtcatcgatgcggcgcgcgaagcggggttcaaatccgtcagcgtcgatttgatttacggcctgccgcaccagacttcggaaagcatcaaaaccaccatcgataccgttttgtcgctcgatcccgaccgcctcgccctttatcactacgcccacctgccgcacgtgttcaaaccgcaacgccgcatcgataccgccgccgttcccgacagcgaagagaagctcgatatgctgcaatactgcgtccaaaccctaaccgaacgcggctacgtcttcatcggcatggatcatttcgccaaacctgacgacgaactctccatcgccctcaaagaaggcttcctccagcgcaacttccaaggctattcgacctacgcggattgcgatttggtcgccatcggcgtgtcgtccatcggcaaaatcggcagcacctattcccaaaacgaacgcgacatcgatgcctactatgccgccatcgacgaaggcagactgcccatcatgcgcggctaccagctcaatcaggacgacatcctgcgccgcaacatcattcaggatttgatgtgccgtttcgcgctcgactatcggatttacgaaagtatgttcggcatcccgttcgaccgctacttcaaagacgaactggcggatttggaaaaactcgccggtttgggattggtgcgcctgaacagccacgggctgaccgttaccccgaaaggacgcttcctcatccgcaacatcgccatggtcttcgattaccacctgcgccataaagaaaccaaggcgaaatattcgcaaacagtgtgattgtggctaacgtacaaatgccgtctgaaaggctttttcagacggcattttgctgccggcaggataagtgttttcaagaacaggcggcggcatatcataacgttccgcacctttgtgtccgaccgttccgaaaccaagatatagtggattaacaaaaaccagtacagcgttgcctcgccttgccgtactagctgtactgtctgcggcttcgtcgccttgtcctgatttttgttaatcactataccaaacggcatatcccgacagaacagattgtgcataaggcacaagcccgcacattccatcaacaaaatgccgtctgaacacgggttcagacggcatcagtattttacaatcagaatactgcctgtaaaaccaagtagcagacaaccgacaatacggcggcggcaggcagggtaatgacccacgccaaaccgatgggcttcatcagtttccagttggcattgcggttgaccagaccgataccgagtaccgcgccgaccaagatatgcgtactggacacgggcagccccatcagcgacgcgcccatcacgacggaggcggcggacagttcggcggtaaaacccgaagcaggatgcatttccgccaaactcgtaccgacggttttaatcacctctttaccgacaaaccacaaaccgacaatcagcgcgatgccgaaagtcagcatcgcaatcggggggacgacattttgcgcggcaacgctgttggtacgcaaaacatccataatcgcggcaaacggaccgatggcgttggcgatatcgttcgcaccgtggctgaatgcgaagccgcaggcggtaaagacctgcatccatgaaaacatctgaaaggtcgatttgcccaagtctttacgcttgaggcttttggcaaaaacaaacgtccccatccacaccgccgcgcctatcataaagatggtcaggaagctgttgacgttgctcatccccaaatgcaggtttttcaagcccttgaaaatcagcatagcggaaatcatcatcgcgccgaacgaagcgataaagggaatccaagaatgcagtgccttgtaggaatcgacattgtttttacggttgtcgaacgcataaagaccgcggtaatactccgattgcagctcttgcggatcgaattcgggttcgtcgtaaatttgcgcgtcgtgcgccattttggtggcgtactcgactttttcggcttcggacaaaccctcgaaaaacaggcggtgccgttctttataggcctttttttcctgcttgatgcccttgagcgtgccttccgcccaagcgttgtaatctaagacgtttttcttgacgcgcgaaaacagaaaataggacaccgcgccgcccaacacgggcgacaatacccaagaaacaccaataccgcccagcttgccccaacgtatcaaatcgcccgatgcggcatcgttcattaccgccatacataccgcgctgccgacaatgccgccgataatggaatgggtggtagataccggaagcccttttttcgaggcaaacaacagccacaacgccgccgccaaaagcgcggacatcataataaacacaaactgtatgggttcgaaatcaacacccttcaaatcgacgatgcctttgcgtatggtattggttacctcgccgcccgcgatgaccgcgccgctgacctcaaataccgccgcaatcagcaaagcctgcgggatggtcagcgtacccgcaccgacgctggtgccgaaagaattggcaacatcgttgccgccgatgttgaacgccataaacacgccgg

SEQ ID NO: 38050 - DNA, 11243 bp, Neisseria meningitidis
cgtggaatcggctccgtactatttgtactgtctgcggcttcgtcgccttgtcctgatttttgttaatccactataattattttttagcgtgtaaaacaaaaccggctgcatacctgcaaccggcctcaaatcagcacaattccttatccaaatccgccaacaggtctttcagagcgtctccgatttcctgaagcgtaaccggacggttgccgtccgaacccgattccgcaccttctgcatacggtgcaaacgtgctctgcaatttcaacagtttcaccacatccaaacgggtgtagcgttcgccgccgtaaccgacaaccacaccgtgatcatgctgccattgcgcaaaaccataggggctgatttgcaacagtccgcacaactcgtccagcgtgaaatagcgttttgcgggaaccttcaaatcaacgttgtttgtcatagtagtgttccaccatgcttttgagtttctggctggcatggaaagttaccacgcggcgggcggtaatcggcacttcctcgccggttttaggattacgacccgggcgttgcggcttgtcgcgcaactggaaatttccgaaaccggaaattttgatttcttcgccgcttgccaaagtgctgcggatttcttcaaaaaagagttcgacgatttctttggcatcgtttttggtgacgttgctgactttgtctaccaaaatatcggccagttctgctttagtgagagtcatatgattaccttctgttgtaacagttgtggattattaccaatttttatttaaaattcaagcgaatatttattttttaactgcgaagccgcgcccctgccgccgttgccgcgccaatcagttttccgataagcggctcgactgcctcatccgtcagcgtgttttccatatcctgcaaaatcactttgaccgccacgctcttcatcccttcgggcagtcccgtgccgcgatacacgtcaaacacgctgatttcctgtaccaacttgtttgccgcgcctttcaagacaagcagcaaatcatcatggctcatagcttccggcatcacaaacgccaaatcgcggcgcaccggctggaatttcgatacgacccgatagcgcgttttcccgcattccaacacggccgccatatcgatttcaaataccagcggcgcttgcggcaggtcgtatttttgcagccatttcggatgcagttcgccgacaaagccgatgactttgccgtctgaaacgatattggcggcacgtccgggatgcagggcgggatgtccggttttaacgaactcgactgctttgtttttcaacagattttccacgtccgccttgatgtcgtaaaaatccgcattgcgcgttttcccgccccattgttccggcatgaccgcgccgtaccacaatccgccgatgcgttcgttttggacaaactggccgtctgaacctttgctgaacacgcgggcgatttcaaacacgcacacgcggttttgtttgcggttcagattgttttgcagaatttccaccaagccgccgatgagcgtggaacgcatcacggcatactgcgccgccagcgggttttgcaggcggatggggtcggcgttggcggcaaaatcttgttcccactgctcgtcaacgaaggcatagctgaccacttcgcggtaaccgcgagccgccatttcgttgtaaacggcaaaacgcgggcggcgtgtttcgggcagttccagcattttcagacggcctgacgtgtaatcgtcggggatgttttcatagccgtaaacgcgtccgatttcttcaatcaaatcagcctcaatttcgatgtcaaaacggaagctcggcgcggtaacgcggaagccttccgccgttttctcgggctgcaggcccaagtgttgcaaaatggtttccacctgttcggcaggaatgtccacgcccaacacggttttcagacggtccaaacgcaatccaacctgcttcgcttcaggcaattcgccttgcgcttccaccatctcgcctgccgcaccaccgcaaatctgcaacaccaattcggtagcacgttcaatggcatccgcctgcaaacggtaatccacgccgcgctcgaagcggaacgacgaatccgaaccgaaaccgtattggcgcgatttgccggcgatgatttcgggcgcaaaccaagccgcttccagcacgatattttgcgtgccgtctgaaaccgcgctcgccgcgccgcccattaagcccgccaaactcaacacgcctttttcgtccgccacgaccagcgtgttttcagacagggaaacggttttctcgttcaggcattccagcgtttccccttcgcgcgcgcggcggatgtgcaggctgccggaaagtttgtcggcatcaaaaacgtgcatcggctgaccgatttccagcatcacataattgccgatgtccaccagcgcggaaatactgcggatgccgctgcgctccaaacgttgtttcatccaatccggcgtagtagcgcgcgcgttcacgttttcaatcacacggctgataaaacggccgcaatcggcaggcgcgttaatctgcacgggctgttttcgactgcccgtgatcggcgcggtatggatttcgggctgcctgaacgcgcaccccgtcaatgcggacacttcgcgcgcaatgcctttgatgctcaagcagtcggcgcggttaggcgtaattttcaacgtaaacagcgtatcgtccaaatccaagtattcgcggatattggtaccgacgggcgcatcttcaggcagaatgtgcaggccgttcacaccgtcgtcgggcagaccgagttcgtcggtggaacacaacatcccgtccgacacctcgccgcgcattttggtcggcttgattttgaaattacccggcaaaacggcacccggcagcgaacacggcactttgatgcccgctttcacattcggcgcaccgcacacaatctgcaccaacccgcccgtacccgcatcaactcgggtaacgttcaaacggtctgcatccggatgtttttcaacggatttcacttcggcaatcaccacgcccgcaaacgcaggcgcggcagtttcagcctcttccacttccaagccggacatcgttaacagatgttccagcttatcggaggaaagttcggtatcggcttgggttttcagccatgagtaggagaattgcatggttaatttctctatatttttaagttattcaataatacaataacctggatgcccaaaactgattctagcttcaggtaaattattttttattttctcaatcgattgttggtaataatcggaattgatttcacaagctgtcaaatcaaactgtgcaatgcagcatgcaatagcaagagttccacttcctaaatgtgtatctaaaatcttatcaccctgctttgcatacatttttaacaaccactgatataattcgactggtttttgtgttgggtgagttttattacgatttttccgcacactaaaccggaaaattttagatggcctatcgaatgacgaccaagccatttccgccatagaaaaattatttaatgtctctggttgattcttatcccaaataataaatcctttattatattcacttctcaaccataactcgccaaaataattcccaccccaaataatttgattttttgacacgcgaaataattcattaaagtaagtttggtctggcttaatatcccattgtgagtattcattcatattgaatttataatcaccaccacgtttagttttattcaaaatcccataaggaggatctacaattgccaaatcaaaatacttgtcaggataccgagacattaagatcatgttatcttcatttgaaatagttatcatgtactatacgcttccattgtggtgttacttgcaaactgttgcatagtcaaattggaaatttctgaactaatatcttttccaagatttttaataataatttcatcaaaataccgataatcaatctctggaatactggagcgattaatcaaacaattatataaaaattcagcaaatgtattggcacgaataattacaattgggcaattacgaatatcggataatacggcagggacataacgtggtgtgacaacaattgtgtaaatggccttaattttatttttatgatcttccaatcttcctgaattaatacctgataacttatttttagttgattttgcctccactgcaaattttctcttttgcgtaatatataagcactctaaatccgtattacctggtccaccaatttttttagcttctacgttataaaacatattgaaccccatttctagaacatcttcaaatagatatgcctctgttccattattattatctgcatattgttcaatcaacctaggtaagtgcaataattcatatgctgcttcatccttaagctcaccaatttcctccaataactcttttggatagaagctataaatttccttaatgacatcaattttcaaacgatcactatcgttcagatttaatggcatttctgaaaacgaataagcactttgcaattttttcacaaattcctgaagttgcttaggaatcgaaaactcacttgatgttactttacgatatgtttcggtcttaccatgctttagacggcaaataattttaccatctgttttttgcaaaacacctgcatcagtcaatgtttttgaaaaataagattcccactcatgtgctgcatttacataagcatgactacgactattttccgcagttaattgatgtttaatttttacttcagcacatgttcgtaacaccaaaatgtcttgtactaatttttcatagctattctgatcagcagatttcacaaatgaaattaaatagatatattcataagaaaatagtttacaatccaatctttcatcagataacaacttaaatattagtctcatgggatataattgaatactttcatcagtcttaatgtacggatgaggaaatggtatcgcccacaacatagtaagaaaaattttttgaatatattcattattatccaagtgtttcaaaaataaattacccaatggactgaacaggaatttctgtgtaacttgcccacacacatcacgataaccaaacatatagaatgataattcttttattttatgagtagtagcatccaatgatttacctgtatttcgtctatggtataaatctagtttttccaatttttcagataacttagctttatcctctacagatataaaagaatttgttttcaaaatacctgcaaatttacataaaatatgaaaattctgtaaatgtttatctattacccagcgcgcagttgtcatatctattttcctattctctctacaatttttttaattaacaatggaggaatagattcaccaatacattgccgaattaataattctgatgtatcgtcgggaatattccaatcaataggtaatgatgttaaaagcattaactctaatggtgttaaaactcttgcatctgaatatgttccatcaggcatagaccgtccaggatgaacatttaattgtgaactgatagcgtcattacgaatagtaatagttggggcaggagcatcccactccatacggcgataagttgtattataacttttaattttttcaccattttttttctttggataatgttctatattatcaaaagcagatcgtcctgttggcgtattttttagccatataatgtgctccggagcatgtgtacgtgcaaaatgccatttcacattagacttttgtccagactcaatactaggcaaaaaactaatagcatcacgaacagaaatggtttttgtaactttttccggcattccccaaatagttgaatgtttattcatacgaataatagctcgtttacgatgttgtgcaacaccataatcggcagaatcaaaaatatgagtttgaatataatattcgcaaccaaataaatcttgcaaaattacttctactgtttgtaatgtccccttataaggtaacttaatttttaaaaaaaatggaacattttcaatcaaaacaaaagttgggcgttttaataaaataaattcgattactctgaatattaaatgattacgtttatcattagccatctcttgaatgttacgatttttccctgcaacactcatgccttgacaaggaggagaagcaattaaaaaatctaatcgattcggcacgctctgtattaaattttgaaacacttcctcatgaagtatatcacctataatcattttactttcgggatatagagctttatataaattagcacgttctggcaccaattcatttgcagctataatcttaatacccgcattatgcaagtaggtttctgcaatccctgcactcgaaaacaaagaagcccctatcatcatagaaccaaacccaaattaactatataatctctacaaagcaataaattatgcctctttaaacaaaattaggaatgtaatttcacaacaaaatatcaaatgttttatatcttacatttgaattttcctaagcagcctgaaaaccaagagtaggctgcttttccatattcaggcagtctgcacgatcatttcgcaaactgcttcaaaaagttcaaatcattatcgaagaacaggcgcaagtcgttcacgttgtaacgcagcatagcgaagcggtcgagaccaataccaaaggcgaaaccggtatatttttcagggtcgatattgacgtttttcaacacgttaggatgtaccataccgcaaccgcctacttccagccatttgccgttttcgcccataatgtcgatttcggcagacggttcggtgaacgggaagaaagacgggcggaaacgtacttgcaaatcatcgcgttcaaagaagcgacggataaaatccgtgaacactgcttttaagtcggcaaaagttacgccctcttctacccacaaaccttccgcctgatggaacataggcgagtgcgtggcatcgctgtccacacggtaaacgcggccgggggcgataatgcggatgggcggctcttttttatcgagcatatagcggatttgaatcggggaagtgtgcgtacgcaaaacatcgccgttttcaacgtaaaacgtatcctgcatcgcacgggcaggatggtttgcagggatgttcagggcttggaaattgtgaaaatcgtcttcgatttcaggcccgtccgccacttcgaaacccattccgtgaaagagttcgaccacacgttgcaaggtcagggttacgggatgcaggctgccgccttcctgagcgcgtccgggcagggtaatatcgagggcttcggcggcaagtcgggcttgcagcttgacttcgttgagggcttcgcgtttggcattaaaagccgtctgaaaccggtttttgcattcattgatatgcgcacctatggttttgcgctcttcaggcgacatttgccccaaagttttcagaagtccggtcaactcgccggttttaccaagataacgggctttgatttgttctagagcgttgaagtcttgcgcagcttctactgcggcaatgccttctgcaacgatgcggtttacattttccataatatcaagtctgtcaattaatgatataccacctgaaacaacgaggccgcctgtatagcctgacatatcagactcttcagacgaccttattttcttcacggtcaatccattggataaattttctgtatagtggattaaatttaaaccagtacggcgttgcctcgccttgccgtactatctgtactgtctgcggcttcgtcgccttgtcctgatttaaatttaatccactatattttaacgcaaatttatttaaaaaaatagactttaaagaaagaaaatcaatcacatagaatttctgcaaacaaagaaaaaaggaagccgcagcttccttttcaattttttggattaagcagccaaagcagctttggctttttcaaccaattgtgcaaaagcggctttatcgaacacggccaaatcagccaatactttgcggtcgatttcaatagaggcgcgtttcagaccgttcataaatttgctgtaagacaacccgttttcacgcgtacctgcattgatacggacaatccacaattgacggaattggcgtttgcgttggcggcggtcacggtacgcgtattgaccggctttcattaccgcctgcttggcaacgcggtaaacgtttttacgacggccgcggtagcctttggctaacgcgaagattttttggtgacgggcacgagcggtaacaccgcgttttacgcgtggcatattctaaactccttaagcgtagggtaacattttagcaacagaagccaaatcgcgatcatttaccatagaggtaccgcgcagttggcgtttgtttttggtggtctttttagtcaagatgtggcgtttgaacgcatgagcgcgtttcacaccgccgttacccagtactttaaagcgttttttcgcgctagacttggttttcattttaggcatgggaaaactccattcgttatcggataaggcattagggggttttaaaacatcggtttcaaacacttgaacccacaatgacacggttttttgccgcaattgaaaacttactccgaagcggcaatcggagtaagcggagaattatagctttattttttcttcggcgcaatcatcatcaccatttggcgaccttccattttgggaaaggactcgatttgcgccacttcagccaaatcttcttttacacgttccaaaagttgcgcgccgagttgctggtgagccatttcacggccgcggaaacgcaatgtcactttgactttatcgccgtcggcaaggaagcggttaatgttgcgcatcttgatttgataatcgccctcatccgtacccggacggaatttgatttccttgatttgcaccctgcttttggtttttcttggcttcgtcgcgtttcttggcctgctggtatttgtatttaccgtaatccatcagtttgcacacaggcggtttagcagttggggaaatctctaccaaatcgacatcctgcccttcggccatagccaaagcttcacgaactgaaacgacaccaagctgttcgcctgactcactgattaaacgcacttctttggcggtaatttcgccgttgattcgtgcttcgcgttcttgagcgatgatgaatactcctataaaaattaatgattgacgagggcatcagtgatttcttgctgcaattgcgcaatgaaatcatccaaatccaaagaacccaaatcttctgctttgcggcgtaccgccactttgttttcctgcttctccttatcgccgacaacgatttgataagggaaacggtattggctgttgtcgcggattttgtaaccgattttttcgttacgcaaatccaactcggcgcggaatcctgccgcctgcaatttggcagccacttcccgacaataatctgcctgattttcggtaatattcataattaccaattgaaccggagccaaccataacgggaatgagcctgcatggttctcaatcagaatgccgataaaccgctccaaagaacctaaaatggcgcgatgcaacataacaggacgcgcacggtcgttgttttcagttacatattcggcattcaaacgctccggcaatacgaaatccagttgtaatgtaccgcattgccaagaacgacccaaggcatctctgacatgatattcgattttaggcccgtaaaacgcaccctcgcccggcaattcgccccattccacgccgcaggcagtcaatgcctcgcgcaaaccctgctctgccttatcccacacgtcatctgaacctgcgcgtttttcagggcgaagagaaagcttgacggatacatcatggaaaccgaactgtttgtagatgcgaatcaacaattcattgaacgcacgagcctcgctgacgatttgatcttcggtacagaaaatatgcgcatcatcctgcacaaaaccgcgaacccgcatcagaccgtgcagcgcaccgctcggctcattgcggtggcaagaaccgaattccgccaaacgcatcggcaaatctcgatacgaacgcaaaccgttgttaaaaatttgaacatgacccggacagttcatcggtttaaccgcatattcgcgtttttccgaactggttacgaacatattatctttgtagttgtcccaatggccggatttttcccaaaaggttttatccatgatttgaggcgttttgacctctttataaccggcggcgttcagctctttacgcatatgctgttcaatcacttgccacaaagcccagcctttaggatgccaaaacaccatgcccggcgcttcgtcttgcaggtggaacagatccaattgcttgccaagtttgcggtggtcgcgcttttcggcttcttcgatacgttgaatataggcttttaattcgtcttttgtcgcccaagccgtaccgtatatgcgttgcagcatttcattattgctgtcgccgcgccagtatgcgcccgccaacttggtcagtttgaagtttttcaggaaacgggtattcggaacgtgcgggccgcggcacatatcgacatattcctggtgatgatacatccccatcgcttccacttcgggcatatcgtcaatcaggcgcagtttgtattcttcgccgcgctcttgaaaaattttaatcgcctccgcacgcggagtcatgattttgaccacatcatagtcttgggcaatcaattctttcatacgcgcttcaatggcggcaacatcttccggtgtaaacggtttttccgtggcgatgtcgtaataaaagccctcttcaatgacggggccgataaccatttttgcattaggatagagttgcttgacggcatgcccgacaagatgcgcgcaggaatggcggatgatttcgatgccttcctgatctttcggagtaatgatttgaacagcagaatcttcaacaatcgggtcgcacgcatcgaccaatttgccgtttaccctgcctgccaccgtcgccttcgccaaaccggcaccgatagacgcagcaatttgagccacggtaacgggggattcgtattggcggactgagccgtccggcaaggtaatattcaacatcaaacgctccgaaagattaaaaaataacggcataaatgccgttatgggaatttggtaggcacgattggattcgaaccaacgacccccaccatgtcaaggtggtgctctaaccaactgagctacgtgccttcaaagaatttttgcattttatcgggtcgttttaatttttgcaagaggtatgtgcgtttc

SEQ ID NO: 38051 - DNA, 4540 bp, Neisseria meningitidis
gcacttcagacggcattttatgccttgccctccatgccgtgatgttcgatggcaaaaccgcttcggcggtaggcggtaaagcgttcgcgcgcgtcggcgagctcttccaagctgttgccgacgatttccaaaacgcgcgcgggcaagaccggagcggtgttccaaaaaccgtcggacaggttcaaaacggtcatgccttcgggaattcggggcagattgccgccgcaggcaagcaggacggatggttcagacggcatggcttcttccgtttcccaaatttcgtgcggaatgaaactctcggcctcgtattgccaaagcattttgtccaattcctgaagctgcccgaacgaatcggaccacaccagtatcctgccgccgtcccgaatcgcacgggcaatcaggcggcaggtgaaaatcggaacttgggcaacgtgcgtgtaaaaggtggctttcggcatattgtttgaacatttggcaggataatgccgtctgaaaggcttcagacggcattgtgggaaaattaaagattccgcagatagttcagcagcaagggaacgggacggccggtcgcacctttttccgcaccggatttccacgccgtacccgcgatgtcaaggtgtgcccatggatagtcttcggtaaagtaggataggaatgttgcggcggtaatcgtgcccgcgccgggcgtgccgatgtttggaatgtcggcaaagttggatttgagttggtctttgtaggtctcaaagagcggcagttgccatgctttgtcgtccacgttgtaggaagcggcaagcaggctgtcgatcaaatcctgattgttgcccatcacgccgctgacatcgtgccccaaggcaacaatacacgcgccggtcagggtggcgacgtcgatgacggctttgggtttgaactgctcggcgtaagtgagcgcgtcgcacaaaatcagacggccttcggcatcggtgttcaacacttcgatggtcagccctttcatacttttcacgacatcgcccggtttgtttgccgcgccggaaggcatattttcacaagtggcgacgacggcaatcaggttaatcggcagttgcagtttgacggcggcgcagaaggtgctgatgacggttgccgctccgcacatatcaaacttcatttcgtccatgttcaggccgggcttgagggagatgccgccggtgtcgaaggtaatgcctttgccgaccaataccacaggcgcggcttctttgtcggctgcaccgaaatagctcagttcgaccaaatagggggcttccgcgctgcctttggcgaccgaccaaaacgaacccatgttttctttgatgtagtctttttcgatgattttggcgtgcgcgcccagtttttcggcttcggctttggcggtgcgcgctaaaaattcgggcgtgcattcgttgggcgcggcgttgcccaagtcgcggcagaggctttgtccgtaaacttgcgcttcggcgacgcgcaaggcttctttgacggcggcttcgtgcgcggtatggaacacggcagtttcaaatttggcgggcttggcttcttttttgtagcggtcgaaacggtaggcggcattgccgaacgcaatcgcaaacgcttcggcaacggctgcagcctgcgcttcttcaaagacgtgaacgtccacattgaccgtttcctgattttgcgcccatttggcggcttcggcggcggccttgttcaatgcggcgcggccggtgcttttcagacagcatacggcaacagcctgcaaaccgttgcctgtcgggatttttgtgtcggcaaaattttgaccttcttcaagcgaagacaaaagggcaaggacggtcgggttgctcagttgcgatgcttcggtgcagacaaataactgtgcgcctgcctgctgttcctgcaagatttcggtttttgtgctaaattccacgtttattctcctgattgagacggttgtcggtagttttcggacggcctttcgctcaaaagaccgtctgaagacggctggcacgattgtaccccatttgaagcaccgtctgaaaccttgcgcggacaatccgcctgcgccgaaccgcttaccgcccccctgaccgcgattctatgatttatcaaagaaacctcatcaaagaactctcttttaccgccgtcggcattttcgtcgtcctcttggcggtattggtctccacgcaggcaatcaacctgctcggccgtgccgccgacgggcgtgtcgccatcgatgccgtgttggcattggtcggcttctgggtcatcggtatgacgccgcttttgctggtgttgaccgcatttatcagtacgttgaccgtgttgacccgctactggcgcgacagcgaaatgtcggtctggctatcctgcggattggcattgaaacaatggatacgcccggtgatgcagtttgccgtgccgtttgccgttttggttgccgtcatgcagctttgggtgataccgtgggcagagctacgcagccgcgaatacgctgaaatcctgaagcagaagcaggaattgtctttggtggaggcaggcgagttcaacagtttgggcaagcgcaacggcagggtttattttgtcgaaaccttcgataccgaatccggcatcatgaaaaacctgttcctgcgcgaacaggacaaaaacggcggcgacaacatcatcttcgccaaagaaggtaacttctcgctgaacgacaacaaacgcacgctcgaattgcgccacggctaccgttacagcggcacgcccggacgcgccgactacaatcaggtttccttccaaaaactcaacctgattatcagcaccacgcccaaactcatcgaccccgtttcccaccgccgtaccattccgaccgcccaactgattggcagcagcaacccgcaacatcaggcggaattgatgtggcgcatctcgctgaccgtcagcgtcctcctactctgcctgcttgccgtgccgctttcctatttcaacccgcgcagcggacatacctacaatatcttgattgccatcggtttgtttttaatttaccaaaacgggctgaccctgctttttgaagccgtggaagacggcaaaatccatttttggctcggactgctgcctatgcacattatcatgtttgccgttgcactcatcctgttgcgcgtccgcagtatgcccagccagcccttctggcaggcggttggcaaaagtctgacattgaaaggcggaaaatgaacctgatttcacgttacatcatccgtcaaatggcggttatggcggtttacgcgctccttgccttcctcgctttgtacagcttttttgaaatcctgtacgaaaccggcaacctcggcaaaggcagttacggcatatgggaaatgctgggctacaccgccctcaaaatgcccgcccgcgcctacgaactgattcccctcgccgtccttatcggcggactggtctccctcagccagcttgccgccggcagcgaactgaccgtcatcaaagccagcggcatgagcaccaaaaagctgctgttgattctgtcgcagttcggttttatttttgctattgccaccgtcgcgctcggcgaatgggttgcgcccacactgagccaaaaagccgaaaacatcaaagccgccgccatcaacggcaaaatcagcaccggcaataccggcctttggctgaaagaaaaaaacagcattatcaatgtgcgcgaaatgttgcccgaccatacgcttttgggcatcaaaatttgggcgcgcaacgataaaaacgaattggcagaggcagtggaagccgattccgccgttttgaacagcgacggcagttggcagttgaaaaacatccgccgcagcacgcttggcgaagacaaagtcgaggtctctattgcggctgaagaaaactggccgatttccgtcaaacgcaacctgatggacgtattgctcgtcaaacccgaccaaatgtccgtcggcgaactgaccacctacatccgccacctccaaaacaacagccaaaacacccgaatctacgccatcgcatggtggcgcaaattggtttaccccgccgcagcctgggtgatggcgctcgtcgcctttgcctttaccccgcaaaccacccgccacggcaatatgggcttaaaactcttcggcggcatctgtctcggattgctgttccaccttgccggacggctcttcgggtttaccagccaactctacggcatcccgcccttcctcgccggcgcactacctaccatagccttcgccttgctcgccgtttggctgatacgcaaacaggaaaaacgttgaaccaatgccgtctgaacctctcttcagacggcatttgttttcattgacacattcccacagacagatagccgttccctattacattacctgtcataacagttccatttttgttaaaactagtctatgatagcggtacaaatattgtttacaatatttaacgcaaatcatttgcaacccgacaaaagaaaaacagaaaaaggaacaaagagatgttagaagcctatcgtaaagccgccgccgagcgcgccgccctcggcatt

SEQ ID NO: 38052 - DNA, 2804 bp, Neisseria meningitidis
cggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctaatcggcggtgcaggcaatgattacttggagggcggcagcggttcggatacttatgtcttcggcaaaggcttcggtcaggatgcggtctataattacgactacgctaccggacgcaaagacatcatccgctttaccgacggtattacagccgatatgctgacttttacccgagagggcaaccatcttcttatcaaggcaaaagacggcagtggacaagtgactgttcagtcctatttccagaacgatggctcaggtgcttaccgtatcgatgagattcatttcgataacggcaaagtactggatgttgccactgtcaaagaactggtacagcaatccaccgacggttcggacagattgtatgcctaccaatccggaaataccttaaatggcggattgggcgatgactatctgtacggtgccgacggggatgacctgctgaatggtgatgcaggcaacgacagtatctacagtggcaatggcaatgatacgctcgatggaggagaaggcaacgacgccctgtacggctataatggtaacgatgcactgaatggtggcgaaggcaatgatcatttgaacggcgaagacggtaacgacactctgatcggcggtgcaggcaatgattacttggagggcggcagcggttcggatacttatgtcttcggcgaaggcttcggtcaggatacggtctataattaccatgtggataaaaactctgacactatgcactttaaaggatttaaagcagcagatgttcattttatccgttccggaagtgatttggtgcttagcgcttctgaacaagacaacgtacgtatttccggatttttctatggtgaaaaccatcgtgtagatacatttgtctttgatgatgcagctatcagtaatccagattttgccaagtatattaatgctggcaataatttggtacagtctatgtctgtgttcggttctaatactgctgcgacaggaggaaatgtggatgccaatatacaatccgtacagcagccgttattggtaacgccatctgcataaggagcctaattacattcatggcttaaactgaaaaacagcaatcaagtttattttgattgctgtttttcttaatattgggataagggtcgtattttaattaaccttaatcggtgcacttctagcaatatagtggattcacaaaaaccagtacagcgttgcctcgccttaccgtactatctgtactgtctgcggcttcgtcgccttgtcctgatttttgttaatccactataattttcagacggccttttgccttttcaaattcaaaccaatcaaacggttttattgcttcatcgcgttggtcaaggctttgatgttgtggcggtacattccgatgtaggtgtctgcgggcgcgttgccgagtgcgtcggaatacagtttgccgctgacgttgacaccggtttctttggcgatacggtcaaccatacgggtgtccttgatgttttcggtaaagacggctttgatgccttcgcgtttgatttgtcggatgatggcggcgacttgtttggccgaaggctcggcttcgctgctcacgccttgcggggcgatgaattcgatatggtaacgtttgcccatataggaaaaggcatcgtgcccggtcaggactttgcgtttggcagcagggacggcattaaatgcggcttgtgcgtcgctgtgcagttttttgagctgcatttggtagttgcccaagcgttgttgataataaactttgccttcgggatcggcctttatcagggctttggcaacgttttgggcataggcggacataaggacggggtcgttccagacgtgcgggtcatattcgccgtggtcatggtggtgtccttcgtggtcatgatcgtggtcgtgatggtgtccgccttcttcttcggctttgaggggttggatgcctttggtcgcttcggtataggatactttgctttgtttgacggcgcgttgcacatcggcagcttcaagtcctaagccgttgagcaggacgagttttgcactgcggatttttttaatgtcgccactggtcatatgataggcgtgcgtatcttggttggctccgaccaaactttgtatggatacgcgctctccgccgatttgtttggctacgtcgcctaaaatgctgaagctggttacaaccggcaggggggcggcagttgcggaggcggtcagcaatgcggcaataagggtgagtttgaggtgtttcataactgttctcctgtgatataacgtaacatctgttatggtaaaacaagccgcctgtttgttcaagcggcttgcggggtcaggtggtgtggcggtggtggcttttgagccatttggccagaatgccgccttctttgccgagtatgacggcaaagacatatcggacgctgcaccagcggatgat

SEQ ID NO: 38053 - DNA, 657 bp, Neisseria meningitidis
ccggcaccacgccttacgacaccgcccacctcgaagtgatgttcgaccaatgtttcagccagattgactatttgcgccgcaaagggacgggcgccggctccggttcgtcggtcaaagtcgcccacctgctcgaacggctccggcagaccgtagaccgtctgaagctgctcaccgacatccaaaccggcgccggcaacagcaaccgcctgaccatcgcgctgatgaactccctcatctacgcggcggtcgaacaatacagcacccgccacctgcgccgcgcagcatccgtatgctcgcccgcagcattaccgaaaacaaaagccaccacggcgaacactacatcacccgcaaccgcaaagaatatttcaaaatgttctactcggcggcaggcggcggcatcatcatcgccctaatggcgctgctcaaaatccgcatcggctcactcggcctcagccccttcctcacttccttgtcggctgggttcaactacggcatcggctttatgatcatccatatgctgcactgcaccgtcgccaccaagcagcccgcgatgactgccgccagcaggcaatcggagtaaaaaatgaaccttgatttaaccgcgcaaaaagtccgtctttcttggaaggatattctgtgggggtatgggaataaata

SEQ ID NO: 38054 - DNA, 305 bp, Neisseria meningitidis
tgctggcagcaaagaaatctgcacgattgtcaatggtgttgaaatacttgtcaaatcttgtagatgccccttgtgagttatataaatagccaaaaacttctttggcaacccgtgatacatccgaagggatatacttccacgcagcaggcatggcaatatatttaatagatatattaatgccgtttctgcaaccatcgcgcaatgggttcctagaatagacttgttgaagttccgtatcaattactttgcgaaattgttcatccgttttgatggcatttactttttccatcgtagtagtgcaagtt

SEQ ID NO: 38055 - DNA, 432 bp, Neisseria meningitidis
gtcgactctagaggatcccctgggattgagtttagaccagactgctcattatactttatgcaggtttgtaaatatttggcaaacttcataaattatgccttgtaatcaagtcatcaaataagcatgtaaataactactatagaaattaaattacaaaaatattatgtattcttttgtgtacaaagggtaccgagctcgaattcgtaatcatggtcatagctgtttcctgagtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgc

SEQ ID NO: 38056 - DNA, 524 bp, Neisseria meningitidis
cccgcgcaggcggcaatctatcggaaatgactgaaacctcgagattctagattcccactttcgtgggaatgacggttcagttgcgttccaacaacaccgcaatctcgaaatccgtcattcccgcgcaggcggaaatccagacctccgacgcggcgggaatctatcggaaatgactgaaacctcgagattctagattcccactttcgtgggaatgacggttcagttgcgttccaacaacaccgcaatctcgaaatccgtcattcccacacaggcgggaatctagactcctgacgcggcgggaatctatcggaaatgactgaaaccccgagattctagattcccactttcgtgggaatgacggttcagttgcgttccgacaacaccgtaatctcgaaatccgtcatttgcgtacaggcgggaatccagacctctgacgcggcgggactctattggaaatgactgaaaccgcgagattctagattcccggttttgtgggaatggcggctcacttgcattccgacaat

SEQ ID NO: 38057 - DNA, 421 bp, Neisseria meningitidis
tcggcatttttttatccgttttgggggtaacttgtttggaaagctgcaacttcataaatacaggattacatttaagttttgggtaacctttttaaaaaaatgcgtgatgacttttgcatttttaaggcgttttttggggtaattcgtgaaaagttaccccaaaagttaccccataaatggcgaaaactcaagcatacgccagcatcctgcaacacaaaaaagccttgaaactgttgaagttcaaggcttttttgtgttgcaggatctgctgtcaatagggtatggtggaggcggggggtatcgaaaccccgtccgatattcctctacaaagcgttctacatacttagttgtgtctatatgagaatcttatttccatcatgccgaccaacaggctttatggataccagttaccttaagtctt

SEQ ID NO: 38058 - DNA, 416 bp, Neisseria meningitidis
gacggccagttcgcgaaaacgacggccagtgccaagcttgcatgcctgcaggtcgactctagaggatcccggcgatggcttgtgcgagttggggcaggatgggggcgttgcggtcggggttttggcttaaaaattgggtgatgaattcgggcactggcacgcagatgcggcggatttgcttgggcagtgctttgatttgcaactggattttttcgcgtatcatgccgggcaccagccattcgtgcgacggcgcgtgcaggcggttgaggacggtcagcggcacggtcatggtcacgccgtctagcggatggtgcggctcgaagcggtaggaaagtttgaatttgccgtctgcggtttgccagaatttggggaactgttcttcggtaatgtgtgcggcggcgtgttgcatcagatcg

SEQ ID NO: 38059 - DNA, 8059 bp, Neisseria meningitidis
gccccaccaacctgtgagtctccttgcctgctggtgtgtgtggccgcccactcacccatgcatcatgacccgtgggatctcagtagccagcgtgcactgattctgcgcacttatcagtgccttcgtacactttgcccacttccacttcggcagtaatctgctcgatgcgttttttcgccgcatcgccggcttcttgagtggttgcggcaatggtaatcgtaccgtcttcggcaatattgatttccgtaccggtttcagcggtaatcgaacggatggtttcaccgcccttaccgataacttcgcggattttgtcttggttgattttcatcgtgaacaagcgtggcgcgtgtgcggacagctcttgcgggcccgcaacggcggctttcatctgatccaagatgtgcagacgcgcttctttggcctgtgccaaagcgatttgcataatttctttggtaatgccttggattttgatgtccatttgcagcgcggtaacgccttcggtcgtaccggccactttaaagtccatatcgcccaagtggtcttcgtcgcccaaaatgtcggtcaggacggcaaatttgttgccttccagaatcagacccatcgcgataccggcaacgtgtgctttcaaaggcacgccggcagacagcaggctcaggcagccgccgcagacggaagccatagaggaagagccgttggattcggtaatttcggagaccacgcgcatggtgtagctgaaatcttcaggtttcggcaatacggccaacaatgcacgtttagccaaacggccgtgaccgatttcacggcgtttcggtgcgcccatgcggcccacttcgccggtagagtacggcggaaagttgtagtgcagcataaagcggtcggtgtattcgccggacagcgcgtcgatgatttgctcgtcgcgcgaagtacccaaagttgcaacggccaaagcttgggtttcgccacgggtaaacaatgcagaaccgtgcgtgcgcggcaatacgctggtttggatgttcagcggacggacggtgcgggtgtcgcggccgtcgatgcgcggttggccatccaaaatttggctgcggacgacatcggcttccaagtgtttgaaaatgcctttgatttcgttggctgccaaagtgtcggtttcttcggtaatcaaggcttcttttaccgcactccaagcttcgtccaatttggcagaacgcgcttgtttttgacggattttgaacgcttctttaatggtttcgccggcaatcccgcggactttggcaaccagttcctcattggtttcaggtgctttccaatcccaaagttccggattgacttcgtcggcaaattcattgattgcattgatggcaacctgcatttgatcgtggccgtaaaccaccgcgcccagcatcacgtcttcgggcaggattttggcttcggattccaccatcaacacggcttttgaagtaccggcgaccaccaagtccaattgcgatttcgccaattcggctttagtcggattcaaaacgtacacgccgtttacataaccgacgcgtgccgcgccgatcgggccggcaaacggtacgccgctcaacaccagcgcggcagatgcacccaacattgcaggaatatcagaatcgatttcaggatcgacggacacgaccatcgctacgatttggatgtcgtggtagaaaccttcagggaacagcggacgaatcggacggtcgatcagacggctggtcaggatttctttttcgctttgtttgccttcgcgtttgaagaaaccgccgggaattttgcctgcggcgtaagtgcgttccaaataatcgacggtcagggggaagaagtcttgaccttctttcacttctttgttggtggtaacggcaaccaaaacaacggtgtcgcccatagagactttaacggcagcggcggcttggcgggcaatttcgccggtttccaaagtaacggtctgattaccgtattggaaggtcttaacgtgtttgtcgaacatcattgttcctttcaaaataccgcactgctaaaacactaataatgcacactaaaatccgaatgtgcatagttagggtttcagaccgtgcggcaggttataaacaagctttcagacggcatttcggacgctgaaagcaattgcggattataaaggcaaccatccttaaaatccagtattgatacaataaaaaggccgtctgaaccatatttctttcagacggccttcaaacttaaaaatcaatcctgagtcagcaaagtcaatgcttcccgatacttctcgacagttttctgaatcacatcggcaggcactttcggcgcaggggcttttttgttccaaccgctttgttccagccagtcgcggacgaattgtttgtcaaaagacggcggattggtgccgactttgtattggtcggcaggccaaaaacggctcgaatcgggagtcaatacctcatccatcagcgtcagcgtaccgttttcatccaaaccgaattcaaatttggtatcgcaaataataataccgcgcgatttggcatattccgccgcttcggtgtaaagccgaaccgccttggcgcgcacttcttccgccaattctttgccgataatgcgtccgcattcttcaaagctgatgttttcatcgtgatcgccgactgcggctttggttgagggcgtaaaaatcacttcaggcagttgttgcgcttcctgcataccttcaggcagttgaataccgcaaaccgagccggttttttgataatctttccaaccgctgcctgccagataaccacgcacaatcgcctctactttcaccggagtgagctttttagccacgacggcgcgtttctctaaagctttggcttcgttttcaggcaaaacatcgtaaaccgtttgaccggtaaagtggttgggcataatatgcgccagttttttaaaccaaaaattggaaatctgcgtcagaatctcccctttgctcggaatcgggtcgtccaaaatcacatcaaacgcggacaggcggtcggaagcgaccatcagcatacgtttatcgtcgatttcatataaatcgcgcacttttccaaaatagatctttaccaaaccaatctcactcatttcgcccccccctgaaaatatcttgaaaataccgacccgacacccgacaggtttgaatcacaaaccgatattctagccgaagtcggcgcaaaacaatacccatggcacaaaaagccaacccgtcaaccgtcggcaaaattttggcactataataccgacagcaagtcctacaatacacttttaccaaaggaaatacctcatgagaatcctattgacaggctcgaaaagccaactggcacgctgcctgcgcgaccgtcttccggaagactgggaaaccattgcgacggattccgcatccctagacattaccgatgccgatgccgtctgcaacatggtcaaaagtttccaacccgacgccattgtcaacacggctgcctatactgccgtcgacaaggcggaaggcgatgcggcagcggcatttgccgtcaatgcttccgccgtttacaaccttgccttggcagcacatcgcgcccatgcccgattcatccacatctcaaccgactatgtctttgacggtaaagggaaaagaccctatcaggaaagcgactttaccaatccttccaatgtatacggacaatccaaaaccgcaggcgagctgctcgcactgtctgccaatcccgacagccttatcctgcggacttcttggctgtttagcgaatacggggacaactttatccgcacgatgctgaaccttgcgcgggaacgttccccgctgtccgccgtccacaaccaaatcggctgcccgacctatgccggcgacttgtccgccaccatcatccgcctgttgcagcactccaatcccgttcgcggcatttaccactacgccggcagcaaatccgtatcctggtacgaatttgcccaacatattttccaagcggcatcgcaacagcagacatccttccccgttcccgaattgactgccgtttcagacaaggaatatccgaccgccgcccccaggcccgcatacagcattttggactgccgcaaaatcgaaaacgacttcggcatcaaaccgtcagactggcaaaaagcccttgcacaggtcgtttccaagctgctctgatgccgcccgcccctctgtttccgccgtcaagcaccgccttggcggttttcttatatagtggattaacaaaaaccagtacggcgttgcctcgccttgccgtactatttgtactgtctgcggcttcgtcgccttgtcctgatttttgttaatccactataaaatctaccgattacacaaacacatatcatctttacacaatcatgcttccatcaacagtaaaacatgatatgattgccaacaataacatctcacaataaattttctaatttttattgaaaaaatcaataaataagaatcctcccaaccgacaaataaaataaagaaagggttaatatgcaacatcgaagaagactagcaatttaccaagcatccaaacgtgcttcctttaccggcaggtcatccgccccgcaaaaacgtaaagaacgttgatttgaaaaaaatgccgcctgaagtcctgcttcagacggcatttttttaccgttcgagaaactgtttcaacctgtcctcatccaaaaaccagtgacagatttcctcatctcccgccaacaaaacgggaaccagctcattgtatttttcttccaaaacaggattttcatccacatcgaccacttccagcccgaacccgtattcatcctgaaaaggtttgagttcgtcgcgcattttgtggcacaagctgcaatattcacgaaacatcaaggtcaatttcatccgcgtttccttatctgtcaatttgcacacgccaaagccttagacgcagcagaatcatggtctatttgggaaaaaacaatgttttcgaggaagatgatactcaagtcctgccaaaaacagtaaaaatgccgtctgaacagttcagacggcatttcgaaaaccgttttacgcttgaacgttgatacccgccgtaaccgtcggttgcgcattgtgcgccgtcagaaacgaagcggcaagctccccgcagcagccgcagcagctcgctacgcccaattgcgactgcaaatcgcccattgtggtcgcgccggcggcgatggtttccttgatttgatggtcggtaacggcattgcagatgcagacaaacattttgtgctccgtgtgttctcaaactatcgtaccgatagcggcttttattatcgtatgcgaatataaataaaaacggttcgcattgcaaggtcggtatacacggtttgtcttggtaattttttatcaagtttgcattttcgattgatttcttattaaaccaaagtagaagcctcagtttcgggaatggtgttccttcactacaccctgcaaccatacgttggcaacatgggtataaatctgcgtcgtattcaaatcggcatgtcccaacatatcctgaaccacgcgcaaatccaagccgtgccgcaccagatgcgtggcaaaggcgtggcgcaggctgtgcgggctgatgtgcccgatgcctgcctgacttgcatattctttgacaatcatccatgccaactgacgggaaatgcccgtctttttctgactgacaaacaatgcgtcgcaattcctgcctttcagcagaagtgggcgtgcctccgtataatagcgttccacccaatacgccgactcctgccccatcgggaccatcctctgcttatcaccctttcccagcgcggtaatacagcccctgtccaaatccacattgccgaagttcagcccgaccgcctcgctgacgcgcaagccggtcgcgtacatcaattcgagcaaagccttgtcccgcaaaccgtgcggcgtgtcggtatccggggcggcaagcagtcgggaaatctgctgctcggtgatcagggtcggaatattcttgtcgattttgggcggtttcagcaaacgggtgggattgtccgtccttatgccttcacgctccatccatatatacaggcgtttgcatgccgataatgcgcgcgcctgcgaactccgttgctctccgtcaacataaaccgccgccgccaaatccgcttcgtccgcatccttcagcattctgcccgattgggacaggcggcgggcgattttttccaaatcgcgccggtaaccgtttaaagtattctgactgagccgcctgtccaaccacagcgtttcaagcagcctgtcgatcaaaccttcttccataccgttccaaacaaatgccgtctgaatcttcttcagacggcatggttcacattatcgggaaagcgtttccaatacttcctgcgcgtgacccgccactttgactttccgccattcatgggcgatttctccatccttattcaagacgaacgtactgcgctcgatacctaacgactctttcccgtacagtttcttcaatttgatgacatcaaacaggcggcacactgtttcatccttgtcgctcaacagctcgaaccggaaaccctgcttggcgcaaaaattctgatgcgcctttacgccgtcgcgggaaataccgaccacggtataacccaatgcctcaaactgttccaaacgcgcattgaaatccaagccttccgtcgtacagcccagcgtactgtctttcggataaaaatacacgaccaaaggcagatgttctgccgaatgaaaatccgcaccgctgctcgaaggcagggtaaattcatatttcacatccatagtcctactcccgatattcccattattcaaaacggcacgcagacgcaccgccgcaattgccaaaccaaccccgattctaccgccccaaaggacaaggattcaaccgccggaaacatccaaaccgacacacgacggcatgaaaaatatccatgtcaaaccacaaaatatgttccgatttaaaaacagaatgttataaaacccaatccccaaaacacaacaagaccgcccgcctacgggcagtctcctgtcagacgacatactttacagatggctgttttttcaacaaaataacgccaatactcaaaaatatggaatcaaaaatgtccatccatactctgaaacgcctgccctcatcgctgctgctcggtctctgcctttccctgccgtcagcccacctttttgccgacaacgacattttagggcaatttttagaacagaacatgcttacctcctccgatccgatagaaatattcgccgaaagcacgatacaccccaccaacacccaagccattacaggcggtctgattctctcctcacagtctgccctggtcgtcaacaacaaaaccggacagatactgtatcagaaaaacgccgacaggattatgcccatcgcctccatttccaaactgatgagcgcgatggtcgttttggatgcaaacttggacatgaacgaaaccgttaccattacgcccgacgaaatcgaccgcatcaaagggaccggcagccgtcttgccataggtacggcacttacacgcaaaaaactgctgcacctgagcctgatgagcagcgaaaaccgcgccacccatgcattgggcagaacctaccccggcggcatgggcgcatttgtcgccgccatgaaccgcaaagcccaaagcctcggtatgtacggcagccgcttttacgaaccgaccggactcaacttccaaaacgtttctaccgccaaagacctgagccttatggtcaacgccgccgcccaatatccgcaaatccgcaccaactcgacttccaactacgcctcggtacagaccaaaaacgggcagcagaactacaaaaactccaatgccctggtcagagaaggcatgtggaacatcgaattgcagaaaaccggctacatacgcgaagcaggcaggtctatggttgtcaaagccaacattcaaaaccaacccgttaccatcgtattgctgaactcgcccacatccgccacacgcgtcaacgacgcccgcaaaatcgaatcgtggatgctgcagcaacgctcctgacatacaaatgcccggcggaaaaccg

SEQ ID NO: 38060 - DNA, 597 bp, Neisseria meningitidis
  misc_feature (578)..(578): N is any nucleotide
cgtttcttccagtgcagctattgatttagttattaatcgttcacttccggatatggcggatggttattgggcattaggtttggggatagaagccgaacgtatccacaatgagcaagcagtaaataatccgaacggtagcgaaagggataatagaaagcagttaatatctgctttagataaaggatttgatggatcttttaaagagaagcattttacttttttacaatctgtgatgatggatgtaacaaagttaggtgttgaatatacaatagatggttggcaaaaaattggaggttggggtaatgggataatcaatgatttatataaaagtgttgtaaaaagagagtggactggaatatttgagatcgttaataataacatcaagcaaggaaatgaagctttaaaaatgaaatcaatagctggttctggatatgaaagctgctgggcaaggaatttggagatgacttaaatacaccgtggaataatctcactcaggctgccgaaataatctataatgacatagtagaccatactagtcaggaatagaaaaaggtgtcaaagccattaaagaattgtcngaaaaaatgaaaaatgctg

SEQ ID NO: 38061 - DNA, 567 bp, Neisseria meningitidis
ccgatccgaccacgcccccgccgattccttcaaacggtttcccgcgttcttcccaattatcgtacattaggttctgctacggttttccgcccaatgtggcaacttggcgccctgtccgaatgttgctgcgcgctttgctgaacttcctgcccttggctttcttctttgtatgggttaaacggcaagccgttttttacatagtccttggcacatcaactccgtcacttctttcaatgccgtcccttgatgcgaatagcagggcgcatccggttcttccgccttctatacagcctgctatatattcaaaggttcttacctgccttacaccgttataaatcggcttgcttcgggtttttcggacaatgtcggaacaaacatatctgcggtaaggttgccgttatttaccgggctcgccttctgttttatccggaagtactgcctgctgttctgttgccgccgattcttgtgctggcgggttcttccgtttttttccgtaacggctcaacattttataggacaggccgacaaacacgggaatcagcaataactattacggcagagtgtaaa

SEQ ID NO: 38062 - DNA, 725 bp, Neisseria meningitidis
ggccagtgccaacagtgccaagcttgcatgcctgcaggtcgactctagaggatccccggcgaccatttgggttttgaataaaggcggtgcgattttggtggagatggacagcgcaatcggggaaatcatcagttcgcctatcgtgatggcgaggacgatcagtgcgaaaaacggaaataggaatcggggaaccggaggaaataaaggggacgaatcccaaaaacgacgcgccggtaacaaataccgccatagcgaatttcagcggggttttgggctgtttgcgccccatttttgtccacattgccgccatcagtccggaaaacaggatgacccacaggctttgcatagaatctttccaagcgacgggcacggtaaacgaaccgatggtgcggttgacggtttcgtcgaaatagacggttgccacggtgtaaatctgaaaccagacggcccaaaacatacagatggtcaggaaaagcgggatgtaggcgatgatgtgccgtttgttgtcggaactgacgcgggggttggtcagcaggcgggcgaaataggcgatgacggcaaggatgacggtagataataggatgccggagaaattgtcgaggttgacaagcccggttttgatggcggttgcaagtgcggcgatgagggcgatgccgacggcggccgcagttttgccctgtccttttgaaagcggatgggggacggtggggtggggcaagttttta

SEQ ID NO: 38063 - DNA, 822 bp, Neisseria meningitidis
ccttcctcggcttcctcaaaggcgtagatttcatgtggacggtcaaacatatccgacaccagcaaccccgtccgtccgaacgcaagcgcaaaggcatcatgcaccgccaacgcaaacggcagcgtcaaaaacaccagtcccgcaaacagagccgcataaggatatttctcgttcacaaacatcgccgtccccctcttccgaagcagaccgcattatatagcggattaacaaaaatcaggacaaggcgacgaagccgcagacagtacaaatagtacggaaccgattcacttggtgcttgagcaccttagagaatcgttctctttgagctaaggcgaggcaacgccgtactggtttttgttaatccactataccgcgcactgccttgccgcccgcccgaaaagttgcacaaacaaccgttcatatatatcatgacgaaaaaacgccggtgtagctcagtcggtagagcagcgcattcgtaacgcgaaggtcgggggttcgattcccttctccggcaccaataccaagcacagaccctcccttcctcgggaagcctgtgctttttcacatttccgcttcagacggcacaaccgatatgaacacctcgcaacgcaaccgcctcgtcagccgctggctcaactcctacgaacgctaccgctaccgccgcctcatccacgccgtccggctcggcggggccgtcctgttcgccaccgcctccgcccggctgctccacctccaacacggcgagtggatagggatgaccgtcttcctgcgacttggcatgctccaattgcaaggggcgatttactccaaggcggcggaacg

SEQ ID NO: 38064 - DNA, 728 bp, Neisseria meningitidis
acttgcatgcctgcaggtcgactctagaggatcccgttacaaaagatcattaaaaaaatctttcaggaaaatgaaaaagagatcctgaaaaacattgatagaattgaacggattcaaaagttaattattggtcaagttatgcataagaccaataatcgagcaaacccccaacaagtttttataattgttgaaaatatgcttcatgaagttcgggaaagagatagctaaaaaaaatcaaattatttatcgctatataatccttaaaattcaaagctttgaatgacctgctaacacccgtatcttctcagaacgccaactagaaatccgtttcaactcctcgggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccag

SEQ ID NO: 38065 - DNA, 333 bp, Neisseria meningitidis
ccagtttcgatcttgattctgtcgataccgaagccccgcgtcccggccaaaatatcaagatgttttttccgaaaaaccgcaagcccgggtacgagctcgaattcgtaatcatggtcatagctgtttcctgagtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgc

SEQ ID NO: 38066 - DNA, 1037 bp, Neisseria meningitidis
ggatgcggatgcgctgaacatattatcaaccgatgccgaaacccgaaatctggcgcgcgggtgtaaaaacctgattttaacgccacaccccgccgaagccgcgcgcctgcttggaacgacggttgcgcaggttcaggcggatcggacggcggcagtgaggaagataggggcaattttcggcgcaaccgtggttttaaaggggcacaaaacattggttgcctcacccgatacggaaatctatgtcaacgaaagcggcaacgcgggattggcaacggcgggcagtggcgacgtattgggcggcatcatcggcagtctgctcgcacagggcgtgccggtttttgaagccgcctgcgcgggcgcgtggctgcacggcgcggcggcggatgtcataaaagaatcggcaggcattgcggcagggctgttggcaggggaaatcgctccggcggcaaggtggctgcgcaaccggataactaaaagtatgtaagaagatatagtggattaacaaaaaccagtacatcgttgcctcgccttagctcaaagagaacgattctctaaggtgctgaagcaccaagtgaatcggttccgtactatttgtactgtctgcggcttcgtcgccttgtcctgatttttgttaatccactataccatacaaccacgccggaattaagtttaaatttgaataaaaggttcgggttctgcaaaatacagaacccgaaccttgttcggatattgaaaccggctgcccgattttgggcggtgcggcttgcaagtatcaagattcgcatatgccgtctgaagctcggagaggttcagacggcatatgcttatttgggctgctcttcaacgaatctcggacctttcaagatgccgttgtgagaatarggcgacagcaggttgtatgcsgcggttttggaaacctgataaccgcggtcggtcaggctgttggcaatctgattgaccactgcgctgaccaaagcccccaacaggccgctgttgctgttgttgctgccttcgcggatgctggccgaacccgacca

SEQ ID NO: 38067 - DNA, 578 bp, Neisseria meningitidis
gacggccagcaacatatacgacggccagtgccaagcttgcatgcctgcaggtcgactctagaggatccccgcggcgaataagggcaaatgtcaggacggcgcgatcggtgcggctgtgggtgagattgtcggggaggctttggttaaaaataccgattttagcgatatgaccccggaacaattagatctggaagttaagaaaattaccgcctatgccaaacttgcggcaggtacagttgcaggcgtaacgggaggagatgtcaatactgctgcacaaaccgcacaaaacgcggtagaaaataatgcggttaaagctgttgtaactgctgcaaaagtggtttataaggtagccagaaaaggattaaaaaacgggaaaatcaacgttagagatttaaaacagacgttgaaagacgaaggttataatttagccgacaacctgaccaccttattcgacgaaacattggattggaacgatgccaaagccgttattgatattgtcgtcggaacagagctgaatcgcgctaataaaggggaagcggcacaaaggtcaggaagttttagaaaaaatcgtcctatat

SEQ ID NO: 38068 - DNA, 387 bp, Neisseria meningitidis
ccgcattgaaagcggagacttatttttgtcgcccttaccattcttgggagaaagggctgaatgagaacaccaacggactcatccggcaatacttccccaaacaaaccgatttccgtaacatcagtgatcgggagatacgcagggttcaagatgagttgaaccaccgaccaagaaaaacacttggctacgaaacgccaagtgttttattcttgaatctgttccaaccactaatacactagtgttgcacttgaaatccgaatccaaggccgtctgaaacgataaggtttcagacggcatttctttctttatagtggagaactttggcatttttttttggctcgcttagcttgatgatacgattctctaaggtgctgtagcacaagtgaa

SEQ ID NO: 38069 - DNA, 593 bp, Neisseria meningitidis
tctgcggctcgacgccttgtcctgatttaaatttaattcactatatttcatatgcttatttatctaacttttccccggtaacaaggtaacaactaagggtatcgcttcctagtataggttttttccaaaaacccaaaaaaaaccgccctgcatcttggacggtttcccccttgttccctacgtcttggcagtattccccgcaagctcttttccgcttggcattcctgatttggcggtcgttcagctttatttttgcggtattttttcgaggtatttttcagataccgcaaaagatatcgtaaattttaggttacttcaattagggcggattggacgggattgcactgtcaggaagggggacggcacgataacaatcagcctgaaatccttgtattgattgcaattggttgacagcgttggatgggattgaacaaaaaacgcctgaaattttcaggcgtttttgtctgttggtgccgacagcgagatttgaactcgcacagcctacggccactaccccctcaagataacgtgtctaccaaattcaccatgtccgcatttgaaaaactgttatttctgctgctgacgaacaaggg

SEQ ID NO: 38070 - DNA, 410 bp, Neisseria meningitidis
cggccagtgccaagcttgcatgccagtgcgaagcttgcatgcctgcaggtcgactctagaggatcccccagacgcaggtacagattaggcggtgtgccgtaatcgtacgaatgccgattcaacctaagcagacatcagtatttaggaagtggatgtttgatggagcaaaggttgtacgaagggtggaaggcaacctgtgggtgtttggtatggtcgcgcttgaaaaaacgtgttttaagggacaaatgccgtctgaaaatcggtttcagacggcattttctgtttatttaaagcaaacaggaaaaggcagcaatattctgcagtcttcctattcacacaagcgttttatagttaattaaaaacaagatagtacaatactcaactttgaaggtctaaccatggcatactct

SEQ ID NO: 38071 - DNA, 555 bp, Neisseria meningitidis
gacggccagctaggaaacgacggccagtgccaagcttgcatgcctgcaggtcgactctagaggatccccgttccgtattggttgcaacacctttgccggcacagtcgggaaatgctgttggattcacggcagcacaaatgaagttcggggacagtaagaatttctcaaaattagagaatctcaaatacccgtgcgaagttatggtaacggttgaaatgacttcgacaggtaagggcatggttccttcattaattgattttcaggtggcagaaaagccgaaaggttgatttatgaaatttgaagaacgtttcatagttcaagacttggaaacgcatgactttatttatcccgatcctttcggtgatgtggggtttactcaaaatattaaatcagcaggtcaatttgaaagctacgaagatgcgttgaattcaggcataaatgaaataggcggaggattccagatatttcagttcttcgtaaaatcggaataaaagaaaaacaggctcggcgggcggtctgtcaacctttcacaaagcccgcaacaaaggaaaaata

SEQ ID NO: 38072 - DNA, 478 bp, Neisseria meningitidis
cccctccgaccgggaagcctgtgatttttatttcccaggcgtatatatgcgggatgaaatggtagttggggcggagggcggcgttttgtatgtcggcgacatcgcccagtacagccgcaacatccaagccggtattgcctttattgtcggaaaggcggaacaccgccgcgtcagggtggtcgcatcgggcagcagggcggcaggttcagacggcattgcctgcgaggaaaagctggcggaactgctgtcggaatcggtcgtccgtattccgccgctgcgtatgcagcatgaagacattcccttcctgatacaggggattgcctgcaatgtggcggaaagccaaaagattgcgcctgcctcattcagtgaagaggcacttgccgcattgacccgttacgactggccgggaaatttcgaccaactgcaaagcgtcgttgcaacgctgttgttggaggcggacggacaggaaatcggcgca

SEQ ID NO: 38073 - DNA, 693 bp, Neisseria meningitidis
ctggtcgggggaagtccactttgttaaacatttcaacaggtagcctaaaacctgaaactggtacagttagtattaatgggcatgatatatatcaagtttctccatcctttattaggggattgagcgggattgttcgccaagatgatgtcctttatgcaggaactattggcgacaataagccataacgcgtgatttaccaacctgttaccattgagccgcgcgagatcacgccgcgtatcgtccgtgaggagaactacggtggccaataaattaagaaactacaccatcaacttcggcccgcaacaccctgcggcgcacggcgtattgcgtatgattttggagctggacggcgaacaaatcgtccgtgccgacccgcatatcggcctcttgcaccgaggtaccgaaaaactgggggaaaccaaaacctatctgcaagccctgccctatatggaccgcttggactatgtttccatgatggtcaatgagcaagcgtattgtttggcagtagaaaaacttgtcggtatcgatgtgcccatccgcgcccaatacatccgcgtgatgtttgccgaagtaacgcgcatcctcaatcacttgatgggcatcggttcgcatgccttcgacatcggcgcgatgaccgccattctttacgccttccgcgaccgcgaagagctgatggaccttgtacgaaaccgt

SEQ ID NO: 38074 - DNA, 609 bp, Neisseria meningitidis
ctggtcgggggaagtccactttgttaaacatttcaacaggtagcctaaaacctgaaactggtacagttagtattaatgggcatgatatatatcaagtttctccatcctttattaggggattgagcgggattgttcgccaagatgatgtcctttttgcaggttctattggggaaaatatttcattttttgatgaaagcccaaatatggagctcattgaacaatgtgcaaaaatggcacaaatacatgacgatatacttaaaatgccaatgggctatgagaccttgattggcgatatgggaaatatcttatcaggtggacagaggcttgagagttattttggagctggacggcgaacaaatcgtccgtgccgacccgcatatcggcctcttgcaccgaggtaccgaaaaactggcggaaaccaaaacctatctgcaagccctgccctatatggaccgcttggactatgtttccatgatggtcaatgagcaggcgtattgtttggcagtagaaaaacttgtcggtatcgatgtgcccatccgcgcccaatacatccgcgtgatgtttgccgaagtaacgcgcattctctgtcacttgatgggcatcggttca

SEQ ID NO: 38075 - DNA, 2343 bp, Neisseria meningitidis
tgccgctgctgctgaagggcgcggacgtgttcaatacggggaatgcgcgttatgtgctgacggctatgtgtatgccctttccggcggtgtcgtgcgtcatcgggctggtggggcggttcaggcttcagacggcatcgggcagggcggcaaagtcagggggtgcgggcaaggcggacggataggacgcatttttcagcgggtgcgtcgagaagcagccgatgtgtttggcagccgcagcttggggggtgtagtgctaatggcggtttctttgcttttatagtggattaacaaaaaccagtactgcgttgcctcgccttamctcaaagagaacgattctctaaggtgctgaagcaccaagtgaatcggttccgtactatttgtactgtctgcggcttcgtcgccttgtcctgatttttgttaatccactataccatacaaccacgccggaattaagtttaaatttgaataaaaggttcgggttctgcaaaatacagaacccgaaccttgttcggatattgaaaccggctgcccgattttgggcggtgcggcttgcaagtatcaagattcgcatatgccgtctgaagctcggagaggttcagacggcatatgcttatttgggctgctcttcaacgaatctcggacctttcaagatgccgttgtgagaatagggcgacagcaggttgtatgcggcggttttggaaacctgataaccgcggtcggtcaggctgttggcaatctgattgaccactgcgctgaccaaagcccccaacaggccgctgttgctgttgttgctgccttcgcggatgctggccgaacccgaccacaactcttttccgttgcgggaatcgaccagccgtgctttggcggatacggtcgtcacgctgtctaaaatttgatatgaagtgccgtattcggtaaccgtaatgtacaaaaccgcatcattgccgaaaatctgatgcagtttttccggccggacggcgtgaatatcggcggcattggtcaagccgttttgtttgaaggtttcctccacgactgcggcggggaagacgtaatagccggcttcggaaagcggcgcggcggtcgaagccagtacaccccatgttccgttgacatcgggcgattcgttcagcggcggaaccaccaaaattgaagccggtttgctttccttgaatgacgtgtagtcgaaatcgggcgctttttgaacttggcaggcagacagcgccaacacggcggcaagccctaaaatcaaaggtttcatcgcttgcctcctttaccggttttcatcaggaagtccataaatacgcccgattcgggaaacagccttttctcttcttcaaactggcggaacgcgccctctttgtctcccgaacgggaaagcagcagtcccagatgggcgtgcgcacccggggcggcattcatttttttgttgccggcttccacaaagtatttttccatcttttcggtctgcttgcccaacgaagtgtcgtcgtttttcaaaccttcatagacggtatcgggatagccgccgtaataatacagggatttttgcccgttgccgccgcaggcggtcagagccaagaccgccgcacacagcgacaaacggctcaaggttttcggattcatcatttctccttaacggttgggttgccatgcgccgttgtcaacagcctgaaccaggctgttgacggcttcgcggattgccaagtctaaaactttgccgttcaaagtcgcatcgtagccggaagtgccgccgaaaccgatgatttcacggttggaaagtgcgtattcgcccgcgccctgtgcggaatagacgatttcggaagtattgacgttgacgatattcagagccacttttgcataggcgatttgcgatttgccgcgacccaaaatgccgaagagctgatgatcgccgacatctctgcgtccgaattcggttacatcgccggtaacgacataatctgcgcctttcaggttatgcgctttgccggaaatgccggattcctgttttaatgcgttcaaattggtgcggttcagtacgttgaagcggttggtctgttgcaggtgcgttactagaatggtttttgcctggctgcccaaacggtcttccccgtcggagaaaatgcctttttggaagctggagcggttgtcgaatgttccgacggaaatcggggtacgaacaccgtgatattgcgtattgtaggaggcgactttctctacctcgagactgcgtgaggattcggtcgcacagccggtcagtgaaacggcagcggcggcaaggacaacggcggtggaaacggttttcataaaatttaccctaaggtcaagttaaggaaataacggggg

SEQ ID NO: 38076 - DNA, 443 bp, Neisseria meningitidis
cgtattgcgcaccgtccccaaagtctccggcgtctgcgaagcgtcaaaaaagatattcccgacagcgggtcccgtcctgaccggcggagaaaacaatatcggcttcgcacaaagcaaacgcttggcggaactcggcgtcaagtccgcataagccgcgtgttcagacggcatggcgttcagatgccgtctgaacactttgcctgtataatccgcatctttactgtccaacttcgcggttcgcaaacctcccgcgttaccaaaactagggttcgatatgtcaaaccaacaagccttggtcatcttttcgggcggtcaggattcgaccacctgcctgattcaggcaatccaaacctacgggcgcgaaaacgtccaagccattactatccaatacgggcaacgcatgccgtcgagctggaacgtgcccgctggattgcgcaggattt

SEQ ID NO: 38077 - DNA, 698 bp, Neisseria meningitidis
gaatatccaataagacaatatgttcttttgaaaaatacttttggwtttttcgccgaaaacaggacggttcaagttgcggaaattgtttgcaattctttaaaagcagcggcggaggtcacaatgaaatgtccgaatggggatgtggcgggcggcagaaatcatcaatgctgccgactgccatacttctgaaatctacaaaatgatgcatcgatcaaacaatataccgctttaaaaaaaccgatgccgtctgaaacgctttcggggtttcagacggcatcaaaagggtacggtcagcggatgatgccgcgcgccgattgtgcgaaaaagtctcggaatacggcaagctcggcttgggtttcggcgcggcggagaatgtctgccttggcttcttcaaacggaatgccgcgatggtagagggttttgtacacgtctttgacggcggaaatctgctctgcggtaaaaccgttgcggcgcatgccttcgctgttgagccccgccggttcggcgcggtagcccgatgccataaagtagggcggcacgtctttgtgtacgcctgcggcaaacgcggtcatggcgtagtcgccgatgcggcagaattggaaaaccagcgtgtagccgcccaaaacgacgtagtcgccgatggtaacgtgtccggcaagcgaggcgttgttggcgaaaatggtgtggttgccgatgac

SEQ ID NO: 38078 - DNA, 6100 bp, Neisseria meningitidis
ttataacataacaaaatctttaacccacaccgacaaaggctgcaccatgaagaaaacattgacactgctcgccgtttccgccctatttgccacatccgcccacgcccaccgcgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaaaacaaagcaggctggaaacaggcgggcatcaaagaaatgcctgacgcaagctattgcgaacaaacccgaatgttcggcaaaaacatcgtcaacgtcggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaaaaccgaagcacaggctttctccgacagcacagacgacaaaggcgaagtggacatcatccccttgcgccaaggcttctggaaagccaatgtcgaacacaaaaccgacttccccgatcaaagcgtgtgccaaaaacaggcgaactactcgactttaaccttccaaatcggtcattcgcaccattaatcccgcccgcacaaaaatgccgtctgaaggcttcagacggcattttttgttcaaacatcaataccaaccgcgcagtttcatcgctttttcaacacggcggatactcatcatgtaagacgcggttcgcaaatcgacatcatactcttgcgccaagttccatatatcgcggaacgcgcgtcgcaggacgacggtttctttctcttgaacttcgtcaaactcccaataatagccttgcaggttttgcacccactcgaaataggaaacgaccacgccgccgcagttcgccagaatatcaggcacgaccaatacgccgttttgacgcaggatcacgtcggcttcgggcgtagtcgggccgttcgcgccttcgactacgattttcgcgcggactttaccggcgttttcggaagtcagttggttttccagcgcgcaaggggcgagtacgtccacatccaaagccaaaagttcggcgttggtaatttctttgccgtaaccggcttcgttggtgatgaagcctttttcttggaactctttaaacaaagcttccatatccaaaccgttttcgttgtaaatggcaacgtcaacagtagaaaccgcaacaactttcgcgccggattgatgcgcgtaataacctgtgtggtaacccacattaccgaaaccttgaatggcgtaagtggcacccttcacgtccttgcccagtttttccaaagcttggacggcggcgaggttcacgccgtaaccggtagcctcggtacgcgccaaagagccgccgaactcaaccggttttccggtaaatacgcccggcgcggaatgtttcaccacgttttcataagcatccaccatccacgacataattttgccgttggtattcacatcgggggcgggaatatcgattttctcgccaatcagcggggcaatcgcttcagcataagcgcgggcgatgcgttccagttccgcctcggaataatcgcgcggatccaaggtaatgccgcctttgccgccgccgtaaggaatacccgcaacgcagcatttgatggtcatccaaattgacagggctttgacttcgtccaaattcacactgggatggaagcgcacgccgcctttataggggccgacggcgttgttgtgttgcgaacggtagcccgtgaaggttttgaccgtgtcgtcgtcgagtttgacgggaaaattgacttccaacacgcgggtcggactcttcaggatttcataaacggccggatcggttttcagccggtcacaggcggttttcacctgtttgcgcgcgatttcaaacggattgagggtttcttttgcaagggcttcagacattttgcttccttttcacaaagagaggttcggaatggaacaagccatcaggttcgcaactataaccaattttcaagcaaaatgtaatagcgtgtagttggaatcggcccgatttgattaatctatatatgattttatttcccaagccgcacggaatccgtctgaaaaaagcggaacacatatccaaaaagcaaatgtccaattaaataaagatataagaatccttttattttttaaaaatttaattggaacggcgccgggatttgcacacccttcccgactccgttccgaaatccggaaacaccgccggcaaaacctgtttcgattgttaacaatccatacattagaagccctgtgcaaacgatgttaaaataaaccttttcaacccgacagaaaaccggattatgaatgcagccatcgaacacgtccaagccgtcgccttcgatttggacggcacactgtgcgattccgtccccgaccttgccgccgccgcagaagcgatgttggaacaactcggtatgaaaccgctgcctgccaaagtggtcgaaagctatgtgggcgacggcatcggcaaactggttcaccgcgtcctcaccaacgaccgcgaccgcgaagccgattccgaactgtgggaaaaaggtttcgtatctatatgaaatactaccgcgaccatttgagcgtcttcacccgcccctatcccgaaaccgaagccgggctggcattgcttaaatctttgggcatcccgctcgccgtcgttaccaacaaaaacgaaatccttgcctccgagcttctaaaacaactgggactcgccgactattttagcctgatactcggcggcgacagcctgcccgagaaaaaacccagccccctgccgctgcggcacgccgccgaagttttgggtatcgatgttgcaaacatggttatggtcggcgactcgcgcaacgacatcatcgccgccaaagccgccggctgcctgagcgtcggcgttaccttcggttacggcgatatgacgctgctctcgcaagacgatgcgacccgccccgactggattatcggctcgctgcccgaaatttacgaaaacctgcaacctcagaaaaacaaagaagagtaggcattcggacggctccggtttgcgccgctatgccgtctgaaacctgccccacgccgaaaccgccgccatgaaaccgcaaaaatccctacgcgcccgcgcgatggacatcctctcgcgccaagaactcagccgcatcggtctgaaacgcaaacttgcaccgcacgccgaaagcgaagaggagttggaaaacgtgttaaacgaatttgccgaacgcaactggcagtcggatttgcgctatgccgaagcctatatccgcagcaaaagccgcaaacacggttcattgaggctgaaacaggctttggcgcaacagggcatagatgaagaaaccagccgcaacctgcttcccgaccgctcaagcgaaaaactggccgccatagccgtgttgcgtaaaaaattcaaacatccggccgccgaccttaaagaaaaacaaaaacaggcacgcttcctcgcctatcgcggttttgatgccgataccgttcagacggcattgaaacatgcctgggatgacggctgggaggaagactgctgaactgaatccttgaatctttttgcatgacggcgtaaccttacctccatttccaacttttccgattgagaataaaatgtccgaacaatccgagaaaaatcacaacccacttcttgaagatgaacgcaaaaacccggtttaccgtatgggtcaggcagttgccggattcatgctcgtcgtttgggcaggcgtattggcactcgtgtttttcctagtcttccgtttttggctttcctaaacaaaatgccgtctgaaaccttcagacggcatcggcagcccatttcggcaggctatcccatcatagctttttttagcttgaattccactttcccattccctaaaatttttccacacccatttcaaaataccctttcttaaaacaggtacactatgacacaacaacgccaactgccttcgcacgaactcattatgtccgaactgatgatgccggacaccgccaatttcagcggcaacgtacacggcggcgaactcctgctcctgctcgaccaagtcgcctattcctgcgccagccgttacagcggcaattattgcgttaccctgtcggttgacaaagtcctgtttaaagaacccatccatgtcggcgacctggttactttctacgccagcgtaaactacacggggcgtacctctatggaaatcggcatccgtgtcgaagcacaaaacatccgtacgggagaaatccgccataccaacagctgctacttcaccatggttgcagtcaaagacggcaaacccgtccctgtccctccgctggaaatcctgaccgaccgccaacgctgccgctacgaaaaagccaaaaaacgcagagacatcagcctgcaagcctccggagacgtgtcctgcggctgctgacggcggactatgccgtctgaaagacaggcacatcgcgccatccgtttccattgcaaacggatgaaatcaagcaaatatagtggattaaattcaaaccagtacggcgttgcctcgccttagctcaaagagaacgattctctaaggtgctgaagcaccaagtgaatcggttccgtactatctgtactgtctgcggcttcgtcgccttgtcctgatttttgttaatccactatacccaaacacagtcaaacaaatttatatgccccatcccttccgaataatttgaaaacacagccgccaaaaacaaaaatgccgtctgaaaacctttcagacggcatttccaacttgatttcaggcagaaagtcagaacgcgatatagctgttcgggttaaccggtttgccgttttgacgcacctcgaaatgaagctgcgttctggaagcatcggtattgcccatcaaagcaacctgctgaccgcgtttgacctgctgcccctcgccgaccagcaatttttggttgtgcccgtatgcggtcaggaaagaagaattatgctggatgatgaccaagtttccgtatcccctcaaacctgaaccggcataaaccactttgccgtcagccgccgccaaaacgggctgtcccgcattaccggcaatatcgacacccttgttgttgccgccgaaatcggcaaccactttaccttgcgtcggacgctgccaaacaatgccgccgaccgaacgcgtgccggaaggcgaagcggcaggagattgcggggcgggcgcgggaaccgctttattttccgcagcgggcgcggcaggttgcggcgcggactgcacaggcggttgcgcggcgggtttcacaggggtttgcacggcagccggtacggcgggcctgctttctacggctgcggttttcggtgcggcatatcctgccggtttgactttaacaatctgaccgatgctcaacatattgtcggtcatgccgttccacgcacggaaatcgtcttgagagatatggtagcgtttggaaatgttgtacaccgtgtcgccgcgcacaatagtatgcgtcgccgcgttaatgtcgacgggtgcggactgtacgggcggttgcgcggcagccggtacggcgggcctgctttttacggctgcggctttcggtgcggcatatcctgccggtttgactttaacaatctgaccgatgctcaacgtattgtcggtcatgccgttccacgcacggaaatcgtcttgagagatatggtagcgtttggaaatgttgtacaccgtgtcgccgcgcacaatagtatgcgtcgccgcgttgatgtcgacgggtgcgtaagaaggaacgtatgtacccgaaacggcaggtgcagacggcggaacataagcaggaggcgtataaaccggcgcgctttgcaccggcggcaca

SEQ ID NO: 38079 - DNA, 219 bp, Neisseria meningitidis
ccgtcaaagccaccggcggcaacagcgcgttgggcggcgacgatttcgaccaccgcctgttctgccgcctgctcgaacaaaacggactctcccaactcaacggacaagacagccaactcctgctctcggtcgtccgcggcggcaaaggacaatttaccacgcaaaccgaagcgcggattcaggcgacggtttcagacgggattggaatcgacacaagca

SEQ ID NO: 38080 - DNA, 393 bp, Neisseria meningitidis
atgacgacgcaggcttcgtctatcatacaggtttcgtggatttcgggcgtgcggttttggaaagttcggattgcgttcatttttcctccttcggtaaggtatatattgttaaaggatttattaaatattccccctgattgcttttaaaatcctgcctgttatatcgaccccgagtaatgttattatcgggaatatcagcttatatatcattttattggacttttacagcataaaccttaaattatacgcccttctttttatatcagcatcacactctatattttttctcgtcattataaaaagcaaaacgagatattcgtaggatagataagaataaagataactcgatatatccctattattttccatttccgcatttttttccaaaatata

SEQ ID NO: 38081 - DNA, 730 bp, Neisseria meningitidis
  misc_feature (536)..(536): N is any nucleotide
caacaaagcaatctagaaacccgtcattccggagcaggcgggaatccagacctccgacgcggcgggaatctatcggaaatgactgaaaccccgagattctagatttcacttccgtgggaatgacgtggtgcaggtttccgtatggatggattcgtcattccgagcaggcgggaatccagacccccgacgcggcgggaatctatcggaaatgactgaaaccccgcgttctagattcycacttccgtgggaatgacgtggtgcaggtttccgtatggatggattcgtcattcccgacaacaccgtaatctcgaaattcgtcattccgcgcaggcgggaatccagccccctgacgcggcgggaatctatcggaaatgactgaaacccccgagattctagattycacttccgtgggaatgacgtggtgcaggtttccgtatggatggattcgtcattccgcgcaggcgggaatccagacccctgacgcggcgggaatctatcggaaatgactgaaaccccgcgttctagactccacttcncgtgggaatgacggttcagttgcgctccgacaacaccgtaatctcaaaacccgtccgacaacaccgcaatcttgaaacccgggattccgcayaggcgggaattcagacctgtccgcacagaaacttatcggataaaaacagttgcccaaaccacgcgttctatagtggattaaattcaaaccagtacggaattg

SEQ ID NO: 38082 - DNA, 1276 bp, Neisseria meningitidis
ggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctcgaaattaaccctcactaaagggaacaaaagctggagctccaccgcggtggcggccgctctagaactagtggatcccccgggctgcaggaattcgatatcaagcttatcgataccgtcgacctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaatakgccgaaatcggcataatcccttataaatcaaaagaatakaccgrkatakggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgt

SEQ ID NO: 38083 - DNA, 556 bp, Neisseria meningitidis
acctgcctatgatttgctctgccacttgggctttgccgtcaaaatgcgtgtgggtgtggttgtcgatttgtttgtccaattcgtcaatcagccggtcaaaatgggcaatcagttgtttgacgctttcgacttgcgtttcatgaacctaatgcagacggtttttctcggcagtccgcatatccaccagttggttgcggcggttaaccaaggcttccaacacttcttccacttcggtgggcaggtggaagggcattgtttgcgaatctgccgtcggtaacgtcatctagaactttaatggcggtaagctagagcatgttcggagtgggaagtaccgtttttaccggtgaaaccttgaaccaatactttagtgtctttattaatcaatacgctcattcttttctccttaggcgtttacggctgcaacaattttttcggctgcgtcattcaggccgtctgcagaagtcagtttcagacctgattcgttcaggattttcgcgccgagttcggcgttgttgccttccaaacgaacaacgacaggaacgttgacgttgatttc

SEQ ID NO: 38084 - DNA, 3986 bp, Neisseria meningitidis
ccgcttttgaaaaagacgttttaaatgcagatatccccgtcctgctggacttttgggctccgtggtgcggcccctgcaaaatgattgccccgattttggacgacattgccgccgaatttgaaggccgtctgaaagtggtcaaaatcaacatcgacgacaacgaagccaccccgtcccgtttcggcgtgcgcggcattccgaccctgatggtgttcaaaaacggcgaagtcgtcgccaccaaagtcggcgcattggcaaaaggtcagctgaccgcctttgtcgaagcctctatcgcctgataaagcgcaatcgaaaaagccgccggaagattccggcggctttttcgcacccttaagatttgtggcggatttcccagcacctatggatttttttgttgcggaaatcttcgggaacggattgtttggaaatgtctttgacggcgtattgttccgataccaagtcgtctaagacgaagctgcgcaggttgttggaaaagtacaaaatgccgtctgaagcgagcagcttcaccgcgccgtcaatcagctttttgtggtcgcgctggatgtcgaggatgtcggacattttcttgctgttggaaaaactgggcgggtccatcacaatgaggtcgaaccgcctgccttccccatatgccgtctgaagatattggaacacgtcggcgcggacgattttgtgtcgttccgtatcgatgccgttcaattcaaaattgcgtttcgcccaatcaagatatgtgttggacaaatcgacggtttcgctggatgccgcgccgccggtggcggcatagacggtgaagctgccggtgtaggaaaacaggtttaaaaaacgtttgcccgccgccgtttcgccgacttttttgcgcgtgtttcgatgatccaaaaaaagccccgtatccaaatacttatcaaggttgacccaaaacttgcggccgttttcggtgatgacgaaatcgtcgcccgccttgccggttttctcgtactgctgcaaacctttttggcgttcgcggcgtttgaggcggatttgttcgggcgcaaaaccggtaacgaaagcgacggcttccaagacttcggcaagccacgcttcgtattcttcgggccgcatcagccagccggtatcgtattcctgaaggtggattcgatcgccgtaaacatcggcggcaaaggggaattgggggatgtcgcggtcgtaaatgcgccaggcttcgatgccgttgcgtttcgcccatttcataaggtgtttgatgtttttgcccaagcggttggcaaacggtgtgatgtcggtcattggtttcaggcggaataaagtggaaaacggcaattttactgtaattaacgcccgattgcttgaccgtttcgggcaaaccctataccatccgtcgcttatcttgtcatacgaagccatcgccttccaacctaaaccgcccttacgggcgcgtttcttctgttgctttgattttgcaaagcatatctgtgcaggttgccgtcgatgtaaaccacaagcaagccgcttgcgacaaccctgtaacttcacattccccgtatcgttacccttccctgcttcaggccgtctgaacctttcggacgcgggcgttgttgtcttccaaggatagccatgtctattaaatttgccgatttgaaccttgataaaaacattttgtccgccgtcagcagcgagggttacgaaagcccgacgccgattcaggcgcaagccattccgtttgctttggaaggccgcgacatcatggcttcggcgcaaaccggctccggcaaaaccgccgcctttctgttaccgactttgcaaaaactgaccaaacgcagcgaaaaaccgggcaaaggcccgcgtgctttggtgttgaccccgacccgcgaactggcggctcaagtcgagaaaaacgcgctggcgtatgccaaaaatatgcgttggttccgcaccgtcagcatcgtcggcggcgcgtctttcggctaccaaacccgtgccctgagcaaaccggtcgatctgattgtcgccacgccgggccgtctgatggacctgatgcaaagcggcaaagttgattttgaacgtttggaagtgctgattttggacgaagccgaccgtatgttggatatgggctttatcgacgacatcgaaaccatcgtggaagcaacgccgagcgaccgtcagactttgttgttctccgccacttgggacggcgcggtcggcaaactggcgcgcaaactgaccaaagaccctgaaatcatcgaagtcgaacgcgtggacgatcaaggcaaaatcgaagaacaactgctgtactgcgacgatatgcgccacaaaaaccgcctgctcgatcatatcttgcgcgatgccaatatcgatcaatgcgtgattttcacgtccaccaaagccatgaccgaagtcattgcggatgaactgtacgaaaaaggtttcgccgcaaactgcctgcacggcgatatgccgcaaggctggcgcaaccgcacgctgatggatttgcgtaaaggccgctgcaaaattttggttgccaccgatgttgccgcacgcggtatcgacgtaccgaccattacccacgttatcaactacgacctgccgaaacaggcggaagactacgtccaccgcatcgggcgcaccggccgcgcaggccgcacgggtattgcgattacgtttgccgaagtgaacgaatacgtcaaagtccacaaaatcgaaaaatacattaaccgaaaactgcccgaactgaccatcgaaggcatggaaccgacccgcaaacgcaaatccgcaggcggcaagccgaaaggcaaaggcggctggggcgatcgtaaatccggcggttggcgcggcgatcataaaccgagcaaagaaggcttcggcggcaaaacgcgcggcgaaggtttcaagaaagaaggctttaagagagacggtttcaaaaaaaccggcgaaggcttcaaaggcaaacgcaaagccggcgattcttttgcaggcaaaggcgaacgccgttacaaagaccgctaagccccaacctgccgcataaaccaatgccgtctgaaaccgatttcgagtttcagacggcatttttgcaatgtttcagcaccgcccggctttgatacccaaaggattaggctgtaataaaaacccttttccgctttggcaacgattgaaaatttccgtaaattcaaatatctagattccttcctgcacgggaatgacacggaagggtttcagatgcagggtgggcattcctgcccacccaatcccgcccttgcaacggtgggcaagaatgctcgccctacggcttgactgttcgatatgatgccgtctgaaaacccaacggcggcatgacaatgccaccctgccaacgcacgtaaatcagaattgccatcccgacatcaaacgcttggaaacaaaatgccgtctgaaaatcaaacggcaacataacaatgtccctaacaaatgcaaaaatgccgtctgaaagctcttcagacggcattggcgcgccgggtttaccgcctcctgccgaaaccgcgcatagcggggcggcggtaattggcgggcgggcgcgttgtcgggcggtaacgctgcgcctgcgccgcctgttgttttgcacggaggctgcgcgtgttcaaatccctgctggtgcgcgcattggggcgtgcggactgatggtaggctgcacgcgcgcgccgggcgacgggactgtcttggttgcctgcccgtgtgaatttgtttgccagcgcgttgccgataaacgcgcctgccgccgcgccgaccaggctttgcagcagccagcttcctgtcgattggtcgtaaatatactgctgcccgtctttaccggtaacgggttgcccgttgttgccgtttgcctgtgcttcggcaggaatggtgtctttgactgcttcgggagtcagttggtaaaccgtatcgtctgcctgctgtgcgagctgctgttgcagggcttcaatctgtttctgctgctgttcgagccg

SEQ ID NO: 38085 - DNA, 133 bp, Neisseria meningitidis
cacctgcacgcacaattcgtgtttccaacgttttgccgataaagggcatgatttcggagtgttcgccgcgattcaccatcgcaatttcctgcagaccggcgatttcttcaatgaaacgaacgcaacgggtgca

SEQ ID NO: 38086 - DNA, 194 bp, Neisseria meningitidis
tcgcgcacgatgatggggggcagttctacggagatagggttgccttcgtagaacgttactatcgcattggtcgtccatgccgtcaacgatgaagttcaacgcgatcgggacgcttaaagacggttttggcatcgccgtcgtcccgcctccgattctggagttgggcaacggttcgggtctgagcatcaacctgc

SEQ ID NO: 38087 - DNA, 741 bp, Neisseria meningitidis
caaaaactgtacgtacagctagtttgcagacccgatgtacgtctttatggacgaagaattcaaccaatatgaaatcgaagttgacaacattggcgatcattttaatttatcgggtatagactatttcggcgaggacgaagatatagatttccacgattgaatacatggaagccaagtacgtctatcaacactatattaaaacacagccttttattttgaggtttggggtaatttttaaaccgtcattcttacgaaaacagaaaatcaaaaacagaaatctcaaatcccgtcattccygcgcaggygagaatctagacattcaatgctaaggcaatttctcggaaatgactgaaactcaaaaaactggattcccactttcgtgggaatgacggaatgtaggttcgtgcgaatgacgtggtgcaggtttccgtatggatggattcgtcattcccgcgcaggcgggaatctagacattcaatgctaaggcaatttatcgggaatgactgaaactcaaaaaactggattcccactttcgtgggaatgacgcgattagagtttcaaaatttattctaaatagctgaaactcaacgcactggattcccgcctgcgcgggaatgacgaagtggaagttacccgaaacttaaaacaagcgaaaccgaacgaactggattcccactttcgtgggaatgacggaatgcaggttcgtgggaatgacggaatgcaggttcgtgggaatgacgg

SEQ ID NO: 38088 - DNA, 397 bp, Neisseria meningitidis
tccacacaacgtcaataattccaacacaaaatacgccaaccgcattggtttgacacgccagcaaccgctttttgcttcacaacagtgatattgtgttggcttttccgtttaaagattgtgtgttaaatggcggacaaagcaccgaggaaggcgaagaaatttattttaaacgcaataacagccagccagccagccagccagccagccagccagccagccagccagccagccagccagacagtcaaccagccagacagccacttataacaaggcgaagacagcaaaaaactgcccgaaatgagcgaaggcgacaaattgcccgtggacaaactctacggcgaacaacactttaccactccgccgccacgctacaacgaagccacgctggttaaagccc

SEQ ID NO: 38089 - DNA, 920 bp, Neisseria meningitidis
cgcgataaagagcacgttccggtttcgatttacttagttaacggtatcaaattacaaggtcaggttgagtctttcgatcaatacgttgttctcctgagaaacacttccgtcacccaaatggtttacaaacacgccatttccaccatcgtaccggcacgctccgtcaacctacaacatgaaaacagaccccaagccgcaccgacttcgaccctcgtccaagtggaaaccgtccagcagcctgccgaataatccgcacgaagcatgacgtgtcatatctttcaataccttaccggacaacggtaaggtatttttattttcagacagcatttaaaaatgttattgcaaaacatccttccattcgcccattgccttttgcggaaggcacttcccgaaggtggcaatgctttggacggcaccgccggcaacggacacgacacccttttcctcgcacaaaccgcaggcatccgggggaaagtgtgggcattcgacatccagccgcaagccctgaacaacacccgatgccgtctgcaggaagcaggttacagcaatgtacggctcatcttggacggacatgaaaacctgaagcaatatattccaaagccgctggatgcagccattttcaatttcggctggctgcccggcggggacaaaagccttaccacccgcacggaaaccagcattgccgccctttctgccaccttatccctactgaaagaaaacggtatgcttattgccgtcctctatccgggacacgaaaacggcaaacaggaggcagaagcaatcgaacaatgggcaaaaaacctgcctcaagaacagtttgccgttttgcgttacggctttaccaaccggaaaaacagcccaccctatcttttggtatttgaaaaactgcgtcaaaaataactgtttgcggtaaaataagc

SEQ ID NO: 38090 - DNA, 1177 bp, Neisseria meningitidis
  misc_feature (1169)..(1169): N is any nucleotide
ttggaagccttctgcaaaggtcaggacacgcttgcgggcattgctgaagacgagccgaccggatgccggtcggtcgtgtcgctgaacaatacctgtgtcgcgctggcatacccgaaagccttgggcgcgctgcgtgtcgacaacgccgtcgtgattacttctccgcgttttacgagcgttcatcaggtcgcactcaaccagtgcatcaaaaaatacggcgtacagggacaatgcggcttggaaacagtgtattgcacatcttcttcttattacggcggaactgtgcgctctttgattcaaaatctcaaataaaacggaaaatgccgtctgaaagatgttcagacggcatttctatatcgacggtcaggattctttcggatcgggcagcaggctgttcaacataatggcaagtacggcgcacaagcccacgccggcaaagctgaagctgcccaatttgagcgtcatgccgccgatgcccgtggtcagtaccgagctgacgatgaccaggtttttcggcagcatcaaatcgactttggcatcaatcagcgttttcacgcccaaagaagcaatcgtgccgaacagcagcagcataatgccgcccattactggcatcggaatggaagccaaaaacgcattgaatttgccgaaaaacgccatgcagacggcaaaaaccgccgcccaagtcatgatgacggggttgctgtttttggtaatcatcaccgcacccgttacttcgccgtaggtcgtaaccggcgggccgccgatcagacccgcaacgcatacgcccaaaccgtcgcctgcaagggttttgtccaagcccgggtctttcgtatagtctttccccgtcacattgccgattgccatgatgccgccgatgtgttcgatggcgggggcgacggcaacgggcagcataaacagtgcagcctgccagttgatctgaggcgtttcaaaatggggaacggcgaaccagggcgcgtgtgcaatgcttgccgtgtccaccagtcccatcagcagtgccaaaacataacccgaagcgacaccgatcaagatgggaatcagcttcatcatcctgctgccgaaaaccgatacgatggcggtaacggcaaaggtaaagccggaaagatcagcgaatcggtatagtcgatgacctgtttgccgtccgcctgacncattgcca

SEQ ID NO: 38091 - DNA, 400 bp, Neisseria meningitidis
aaaaattgggtggttttaccaaaawtttaaggggaattttaacaaattattaacgcttacaatttgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctmgaggtcgacggtatcgataagcttgatatcgaattcctgcagcccgggggatccactagttstagagcggccgccaccgcggtggagctaccagcttttgattacccttatagtgacgggttaatt

SEQ ID NO: 38092 - DNA, 870 bp, Neisseria meningitidis
  misc_feature (867)..(867): N is any nucleotide
ttgaagaaatatgcaggggagggtatatgcggatttttactttcagcttaatgtgtmtcaaatcgggtgtggggtatgtatagtggattaaatttaaaccagtacggcgttgcctcgccttgccgtactatttgtactgtctgcggcttcgtcgccttgtcctgatttytgttaatccactataaaaagccgcatcgtgaaaagatgcggcttcaggtatcggttggattattcttcagaaccggtgtaaggacggatgctgacagttttacggttcagcgcgcctttggttttgaattcgacataaccgtcaactttggcgaacaaagtgtggtctttgcccatacctacgttgtcgcctgcgtggaatttggtaccgcgttggcgtacgatgatggaacctgcgggaatcagctcgttgccgtaggctttaacgcccaagcgtttggcttctgaatcgcgaccgttgcgggtgctgccgcctgcttttttacttgccatttgtaatgctcctaagttttaaggttaggcgattgccacgatttcgatttgggtgaaattttggcggtggccttggcgtttttggtagtgtttgcggcggcgcattttgaagatgcggactttttcgccacgaccgtgtgccactactttagccgttacttttgcaccttcgataaagggtgcgccaacttttacagattcgccgtcagcaatcatcaaaacttcggtcagttcgatttggctgtcgagttcggctggtatctgttctactttcaatttttcgccgacggaaactttatactgtttgccgccggtttttacgaccgcgtacatactcaactccataagggttatggttaatatccnggg

SEQ ID NO: 38093 - DNA, 1225 bp, Neisseria meningitidis
gtaagattcaccgtctggaagactggggtcgccgccagctggcttacccgattaacaaaatccataaagcccattacgttttgatgaacatcgaaaccactcccgaagtggttgaagagctggaaaccgcattccgcttcaatgatgcartattgcgtcatctgaccatcaaaaccaaacacgccgttaccgaagcatcccctatgttgggtggtgaaaaggctaagaacctgttgagcggtgcgtctgaagaagcggtcgcccaataattgggattcaataatcttgtttcgcttgccgcgttaattgaaaaggttttccctattcgatatacgcctgccggaatccctgttttagatattattttaaagcacgaatcgtggcaggaggaaaacgggcagcaatgccttgtccaattggaaattccggcacggattttaggcaggcaggcggaagagtggcagtatcggcaaggtgtatatgttcacgtcgaaggttttttagctcaaaaaagcagacgttcccttatgccgatgctcaggatacaaaatattcaagaatataaaggttaaacgacaatggctcgtcaatcattcaaacgtagaaaattctgccgtttcacggctgaaaaaatccaagaagtcgattacaaacaagttgatttgctgaaagacttcatctccgaaaacggtaaaatcattcctgcacgcatcacaggaacgaaggcattctaccaacgccaattggctgttgccgtaaaacgcgcacgcttcctggctctgctgccttacaccgaccaacacaaataattttggagattgaatcatgcaaattattctgttagaaaaaatcggcggtctgggcaacttgggcgacatcgtaaccgttaaaaacggctacgcccgcaactttctaattcccgcaggtaaggcaaaacgtgcgaccgaagcgaatatgaaagagtttgaagcacgccgcgcagaactggaagccaaacaggctgaaattttggcagatgcccgagtccgtcaggaaaaattggacggtcaaaccgttaccgttgctcaaaaagctggtgtggacggtcgcctgttcggttccgttaccaatgccgacattgctgctgcaatcgttgctgccggcatcgaagccgtgaaagcaaatgtacgtctgccgaacggtcctctgaaagccgttggcgagtacgaatggaagtggctttgca

SEQ ID NO: 38094 - DNA, 549 bp, Neisseria meningitidis
ggagcgatgtagccccattcggcgaggacggtcgtcataccggcgttgcgccccgcctgtatatcgcgttccgcgtcgccgacgtagagtgtgtgttgcgggtcggcgtggatttgtccgcacgcatacagcatgggtttgacgctgggcttgggctcgccgcaggtgtcgccgctgacgacgacggcgggtgggatgatgaagccgagtttggggacgagtttgtcggtgaagcgcatgggtttgttggtgatgatgccccatttgatgccgcgttttccgagttcggcgatgagttcgtttacgccgtcgaagagggtggtgtcttgggcgtagcggctgtcgtaatccgcaagggaatccggtgcgcaatcgggcatagtcgggatggtcgggggtgatgcctgcgccgagcttgatcagtcctgccgcgccgtggctggcttgggtgcggatttcgtccatgctttttgcaggtagtccgtggcgggcgagcaaggtgttgagtgcgccgccgaggtctaaggcggtgtcggcgagcgtgccatc

SEQ ID NO: 38095 - DNA, 889 bp, Neisseria meningitidis
  misc_feature (21)..(21): N is any nucleotide
acgagccgagcaaccatttgngatatcgacgcgatgaatccggcggcaaggtttgcctgatagcagacgaacaccagcccgacatcaagctgtccgcttgaggcgagtccgcgcgaatagctgtaggcgcggcggaagaggcggtgttttttgaggaattcgggatcgcgcggattcgccaggcgtatatggctgtctttgggcgtgatatcaccctcggggtctttggcaaaatccggttggtcggcttcttttttgccgtccatcggcgcaccgctgtatttgcgccgcccgaaaatgtcggtttgctcttgaagcggcgtcctgtcccaaaactcgacaaagtggcggataaggcggactgcctgatagctgccgtttttcgcccactccggttcgtcgaggctgttggcggccacccccgtccacaaaacctcgtcggcagttttgggatcggaaactttggggttgcccgtgccgtccctgaagcccaacaggttgcgcgccgccatcgcgccgggttcggatttgggctgccacccgtcgatactccaacggataacggcggtttggacggtgtgtttgatgatgtcgcgcaggcggcttggcaggtttcgggggtgaaggcacagatttgcaggctcaaatcgccgtcgcaccagcttttttgcagcttatcgttggagaagtcgcgcatttcctgcaaatgaatcggttttttgtctttgagtccgaaccggccgtcaaacaggctgctgcccacccccacggtaacggtcaacccgtcggggttgaaggctttgcccaaaatgccgctgccggctggcggaagtttgtcgtcgccgtcttggtaatcgccgcctttggtgagaaactcgatgcgggcggt

SEQ ID NO: 38096 - DNA, 596 bp, Neisseria meningitidis
aaaaaccaggtttggcatcctccaataaagaagcgcgcggctttgcaaaaccagcccaaggtaaaggggaatgggcaatattcaacaataaaggacaaagacagggaacgcaaatttatctataataaaagcggccggggtggaggctctgtctttttcgacaataccgatacccttgtttcccgacaaagcggtactgccgtttttggcacagccacctacctgccgccctacggcaaggtttccggttttgatgccgacgggctgaaagagcgcggcaatgccgttaattggattcatacgacccacccagggttgataggctacagctacaccagtgtcgtatgcagagacagcacaggctgtcccaaacttgtgctataaaacccgattttccttcgacaacaccggtttggcaaaaaatgcgggcagcctggataggcacccggacccaagccgcgaaaattcgcccatttacaaattgaaggatcatccatggttgggcgtgtctttcaatttgggcagcgagaataccgtcaaaaatggcaactcattcaacaaattgatatcttcttttagtgaagacaataataatc

SEQ ID NO: 38097 - DNA, 748 bp, Neisseria meningitidis
gccggcggcggaagaggcgttttcaaagttcaaatggaaacgttgccgctkcaaawamagcraktgtacaccgtcaaaaacgtatagtggattaacaaaaatcaggacaaggcgacgaagccgcagacagtacaaatagtacggaaccgattcacttggtgcttcagcaccttagagaatcgttctctttgagctaaggcgaggtaacgccgtactggtttttgttaatccactataacgcaagcaccgcaaagccgcgccaaccctctcccaaccttttttcagacggcattttcggtaatctgctaaaatcgcccgcttgagtttccacagaaaaatccgaaaaatgaatattttttacgaagagtccggccaattcaaaatcgccgccatcatccaaaaaaacgatgccacctaccaagtcgataccccacacggcaaacgcaccaaagtgaaggcgaacaacgtctttgccgagtttgacggcgatatggcggcgtttttggaaaacgcgcaggcacaggcggcggacatcgacaccgatttattgtgggaagtatgcggcgaagaggaatttaccgccgaagccatcgccgaagaatattacggccatgcgccgaccaaaaccgagctggcggcaactttgattgcgctttacgccgcgccgatgtatttctacaaaaaagccaaaggcgtgttcaaagccgcgcccgaagaaactttaaaacaagcacttgccgccatcgaa

SEQ ID NO: 38098 - DNA, 116 bp, Neisseria meningitidis
tgggcagagaattgtgttcatgtctggcattgatttttcctgtcccattatcatcgtcgttaaaagagtatttcccattttgacgtggttcgtagaatactgaatgggtatactcc

SEQ ID NO: 38099 - DNA, 507 bp, Neisseria meningitidis
  misc_feature (439)..(439): N is any nucleotide
ccccgtaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggcgcacaaaacggacttgactgatgtgtggacgacttaaactgaaagcgggtccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacagacttcataaaacttcagtcggaatganattatggacacgccaaacctataaatacatcgacgatgccgagatcgaagtacaacgccgccgctctg

SEQ ID NO: 38100 - DNA, 1638 bp, Neisseria meningitidis
cctgaaacgctggaagccaaaatgctgaccggcaaatccggttacgatttggtcgtgccgggcatcgccttcctgccgcgccaaatcgaggcgggcgcgtatcaaaaagtcaacaaagacctgattcccaactataaaaacatcgatcccgaactcttgaaaatgctggaaaccgccgacccgggcaaccagtatgccgtcccctatttctccggcgtgaacacgattgcgattacggcgaagggcaaagagcttttgggcggcaagctgcccgaaaacggctgggatttgctgttcaaacccgaatacacccacaagctgaaatcctgcggcatcgccctgtgggacaccccgagtgaaatgttcccgattttgctgaactacttgggcaaagaccccaaaggctcgaatcctgaagacttgaaggcggcggcggaagtgttgaagtctatccgtccggatgtcaaacgtttcagcccgtccatcatcgacgagctggcacgcggcgacatctgcctggcggcaggcaacggcggcgatttgaacttggcgaaagcacgttccgaggaagtgaaaaacaacgtcggcatcgaagtgctgacaccgaaaggtatgggcttctggattgagtcttggctgattcccgccgatgcgaaaaacgtcgccaatgcccacaaatacatcaactacacgctcgaccccgaaatcgcggcgaaaaacggcatcgccgtaacctttgcccccgccagcaaaccggcgcgcgaaaaaatgcctgccgagctggtgaacacccgttccatcttcccgaacgagcaggatatgaaagacggtttcgtgatgccgcaaatgagcacggatgcgaaaaaactgtctgtcagcctgtggcagaaaatcaaagtcggcaccaactgatttgaagcattaaaaatgccgtccgaacgatgttcggacggcattttatattggattgaaatagaaatatttatatagtggattaacaaaaatcaggacaaggcgacaaagccgcagacagtacaaatagtacggaaccgattcacttggtgcttcagcaccttagagaatcgttctctttgagctaaggcgagccaacgccgtactggtttttgttaatccactataccgtcgttcccacggtcaggatttcagattgcggacatctgtcagaaaagacaaaaaaccttccgccgtcattccctacaggcgagaatccgatccgttgaaattcggttgttttaaataaattcttgcagctttgattttctgtttttccgataacgccgtaactttgaaacgcgaaagcggtaatccgatccgttgggattttgcaacttcaaatcaatccgcaaactgaaatcccgtcattcccgcgcagtcgtgaatccgaacgcgtccgcacgaaaacctgcatcccgtcattcccacggaagtgggaatctaggacgtaaaatctcaagaaaccgttttatccgataagtttccgcaccgacagacctggattcccgcctgcgcgggaatgacgaaatttcggcgagccgtagggtgggctgtaaggtcggcgtccagcccgaaatgtttgcggttgcccgcttcggcgcggacttcaaacaatggcttgcg

SEQ ID NO: 38101 - DNA, 159 bp, Neisseria meningitidis
cttagatctcataccatgtcattgtgacttaccctccaggaagcttcctcactctgagaaggccccattatttgttttttccaagatgctgactggtaaatatttctaggaaaaaatagaaatgattctactttgtttgtctataaattcatcgtcctt

SEQ ID NO: 38102 - DNA, 590 bp, Neisseria meningitidis
cttcagggtactttgaattttttttcaatatatctgccatatgtttttgttagccgaatttttaggaataccaaccaacgccaggagtataaaaatgattgaacttcaacttcatgaattgaagctggtttcagggggaggtcctgtaacagacaatatagctggaaatgtagctaatgctgccacaaccaaaggaggtcccacatggggggatttggttgcaatacctgctgccgcagcggcagtttattatctgccgaaaaatgcttacggtgctgctggtgcaaatggtgtatacaatgtgactcgtaattgggtaaatgatgccgttaatgcacctccttataacggaagaccaatctttgagattgaacatggattaactgctcccgcaacaaaagcagataaatcagggaacggctacactgacggtacagattactgctgatatttctcatcgtccagacaatctctaggggtcgtctgaaactttcttaacttcaattttatgaatagacccaagcaacccttcttccgtcccgaagtcgccgttgcccgccaaaccagccttttttttttttttttttttt

SEQ ID NO: 38103 - DNA, 273 bp, Neisseria meningitidis
ccgccggattttctcctcttttaatatagtaaaattcatgacccctatgggattttcaggaatatgtcttttatcttcataagcctcgtattcaggataggcagatggcatttttttaaccccgtaagtgagcaatctttctcccatagtcgtgcttaaactacacgcatcttttcggataacaatatcgtccacgctatccaaaccgtcgcgtagaaattggataaagtgcgctttgttttgctggatgtatggctcgagcacccagccttg

SEQ ID NO: 38104 - DNA, 334 bp, Neisseria meningitidis
tggagtacccgcagaagaaatctgggcattgccatttcaacatatcgccgccggctttcgcgctataccacataaagggcagggacgcggcaagcagccagtggaaaaggcgggtggggatgtcccagactttggttttgtttttcataatcggtttccggcggtagaatcggtttgttttcgagccttattttaaccgattggaggggcaatgtttcccgtttttcatctttcatgcgagagccgccgccagatgcttcagacggcattgcgttttccccatgtgttcaaagcccgtgcggaagattcggacatagggactttcggcacgctc

SEQ ID NO: 38105 - DNA, 435 bp, Neisseria meningitidis
cctgcccggtgctggaaggttaattgaagatgtgagagcatcggatcgaagccccagtaaacggcggccgtaactataacggtcctaaggtaacgaaattccttgtcgggtaagttccgacccgcacgaatggcgtaacgatggccacactgtctcctcctgagactcagcgaagttgaagtggttgtgaagatgcagtctacccgctgctagacggcaagaccccgtgaacctttactgtagctttgcattggactttgaagtcacttgtgtacagatacgtgggaggcttagaagcagagacaccagtctctgtggagccgtccttgaaataccaccctggtgtctttgaggttctaacccagacccgtcatccgggtcggggacagtgcaaggtaggcattttgactggggcggtctcctctcaaagcgtaa

SEQ ID NO: 38106 - DNA, 619 bp, Neisseria meningitidis
  misc_feature (497)..(497): N is any nucleotide
ctcggtacccgagcattacgaattcgagctcggtaccctgcgacagggcggcaatcaggcggttgcggcgcggaaaattgccggcatacggccgcgtgccgatggggaactcgctgacaatcaatcctttttcggcgatttcataggcaaggtttttgttgaccggcggataaatgcggtctatgcccgtcccccacacggcgatggtgccgccttctgcctgcaacgcaccctgatgggcggcggtatcgatgcccgaagccatacccgacacaacgggaatgcctttcccacccaacgacttgccgaaatctttggcaatccgcatcgcctgcggcgtggcatgacggctgccgacgatggcggcggaaggtttgtgcagcagttgcacgttgccgcgcaaaaacaaaaccggtggcgcggtcagcccctgcgtcagcatttcgggaaaatcttcatcctgaagcagcatcaggcggcatccgtcacgcatttcncattccaatgccgcttctgccgcctgccgcgccagagcgcgtttttccgcattgcgccaagcctcaagcgcctgtttgtgccgtatcagtgccgccaactgttccgccggtgcggacaaggc

SEQ ID NO: 38107 - DNA, 1296 bp, Neisseria meningitidis
aaaatcagaaaagccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcgtcgcctgcatcgtttaccttgccaaaaccaaagtcctgcctttctgaaacaccgttatgaacaacagacattttgccgtcatcgccctgggcagtaatcttgaaaaccctgcccaacaggtacgcgccgcattggacacgctgtcgtcccatcctgacatccgtcttaaacaggcttcctcactgtatatgaccgcgcccgtcggttacgacaatcagcccgattttgtcaatgccgtctgcaccgtttccaccactctggacggcattgccctgcttgccgaactcaaccgtatcgaggctgatttcggacgcgaacgcagcttccgcaacgcgccgcgcacattggatttggacattatcgactttgacggcatctccagcgacgacacccgactcaccctgccgcatccgcgcgcgcacgaacgcagtttcgtcatccgccctttggcagaaatcctccctgattttgttttaggaaaacacggaaaggttgccgaattgtcaaaacggctgggcaatcaaggtatccgtcttttaccggacaggtaattccgcacgcggatgccgtctgaaagcctttcagacggcatttttcctttgccgccaacacgcgtgcaaaaaaatcgccccttggaaaagggggcgcaaaaggaacacaaaccactaccaaaactttaaatctgaaacactgcctgccgcatactgtatccgacaggatataaagccctcactaaatcgtttcgagaaatccaaacttcttcatcgccgacagaaaatctgcctttctccggtaccagctccaacagaaacggttgaaccgccgtatgcagcctgtccttacaccgccccagctttctggacaacgcggacagggcgcgtttgtaggcattatccttgcagtcaagctcccgcgcactgccgacccagctcaaacgaaggttgcggctttcatcctcaatcagcaaaatgcctgttttgacttcccccacctcgggctcgcatgaaagcgcaatataatatttgccgtcgatgttgacatacgccgcttcatgcacg

SEQ ID NO: 38108 - DNA, 263 bp, Neisseria meningitidis
taagtttccgtaccgacagacctggattcccgcctgcgcgggaatgacgaagctatccttttggccgaaggtcaaaaatcagccgtcacagagtattacctgaatcacggcgaatggcccggcaacaacacttctgccgcctgggaacctcctcaacaatccaagggaaatatgttaaaggaattacaatcccaaacggggtcaataacggcaaaatgccttcaagccgggttaacaaagaaatccaagggaaaaaactcccc

SEQ ID NO: 38109 - DNA, 349 bp, Neisseria meningitidis
agtgcttgtgttgtttgcaccggttgctttcggataatcgtgggtaatgcgttcggcggcataagctaaatccgcctgcacataatacgggctgcggctgccgtcttcacttgccgcctgcgctgcggaagagaagagaagagaagagaagagaagagaagagaagagaagagaagagaagagaagagaagagaagagaaggttttttgggggctggattcattttcggctccgtattcggttttaactgattaaaaagaaagattttcaatgatgttgcaggagcggactatatcacgtttgtggcgatgtttcaacacaatatagcggatgaacaaaaaagagaacg

SEQ ID NO: 38110 - DNA, 711 bp, Neisseria meningitidis
acgggacctttgatgctgatgctgctggtcggcacgggtattttgctgactgttttattaaaaggtttgcagttcacgatgttgggttatgcgctgaaacaggcgtttatgccgccaaagaagcataaaagcggcgaaggccacgaaggcgatatttcccattttgcggcgttgatgaccgcgctgtccgccaccatcggcacgggtaacatcgccggcgtggcgactgcggtggtaaccggcggcccgggcgcggtattttggatgtggatgaccgccattttcggcatggccaccaaatacggcgaaggcgtgttggcggtgaaataccgcgtcaacaattccaaaggcgaaatgtccggcggcccgatgtattacatcgaaaaaggcttgggcaaaaactggaaatggatggccgtcgcgtttgcgctgttcggcacattcgcttccttcggtatcggcagctcggtgcagtccaactcggttgcacaggcggtgcaaaccagcttcggtatcgaacctgcctataccggcattacgttgaccgttctgactgccgttgtcgttttaggtggtattaaaggcatcgccaaagccgcttctttcatcgtgcctgctatggcggtgttttatgtgttgggcggtctttccattatcgcgattaattccgatgcactgatgcctgccgtcaagctgattttctccgatgcg

SEQ ID NO: 38111 - DNA, 129 bp, Neisseria meningitidis
aaaacggtaaaatcaattcatacttgaatacgttctgcgcctgccggctgggaacaggcgcacggataatgctttgccgagtgcgtttttaataaacaattccgttttaaagtaaaccgtttcatgagg

SEQ ID NO: 38112 - DNA, 384 bp, Neisseria meningitidis
tacccggttcttaaagttgaaaacgtctcattcagatatgctgataatgagccatatctttttgaacacattaatttggaatttagagataatgaagcagttgttttaacaggacaatctggtcgggggaagtccactttgttaaacattttaacaggtagcctaaaacctgaaactggtacagttagtattaatgggcatgatatatatcaagtttctccatcctttattaggggattgagcgggattgttcgccaagatgatgtcctttttgcaggttctattggggaaaatatttcattttttgatgaaagcccacatatggagctcattgaacaatgtgcacacgtggtacacatacatgatccatatacttaacatgcc

SEQ ID NO: 38113 - DNA, 826 bp, Neisseria meningitidis
  misc_feature (116)..(116): N is any nucleotide
aaaagttgataaatggtagtagcatatggtctcataatttcaagcttagaaattagttaaagaataggggctgtcctagataactagcgaaattcaaattaagttagaattatccntatgagaaaaagtcgtctaagccagtataaacaaaataaactcattgagctatttgtcacaggtgtaactgcaagaacggcagcagagttagtaggcgttaataaaaataccgcagcgtattattttcatcgtttacgattacttatgtatcaaaacagtccgcatttggaaatgtttgatggcgaagtagaagcagatgaaagttattttggcggacaacgcaaaggcaaacgcgttcgcggtgctgccggtaaagtcgccgtattcggtcttttgaagcgaaatggtaaggtttatacggttacagtaccgaatactcaaaccgctactttatttcctattatccgtgaacaagtgaaacctgacagcattttttatacggattgttatcgtagctatgatgtattagatgtgcgcgaatttagccattttagcttcgctgaaacttcgttttcgtatcaatcacagcacacattttgccgaacgacaaaaccatattaatggaattgagaacttttggaatcaggcaaaacgtcatttacgcaagtttaacggcattcccaaagcgcattttgagctgtatttaaaggagtgcgaatggcgttttaacaacagtgagataaaagttcttgttccattttaaaacaattagtaaaatcaagtttgtcctagttatctaggacagccccttgttttttgttcggcgggg

SEQ ID NO: 38114 - DNA, 1200 bp, Neisseria meningitidis
cacatccgtgcctgtgtcattgtcaaaaataccgtaaatagattgtatatcctttttatcaacatcatcctcactcaaatcactgcccgataccgacagataaccacgcgtttgtctttcagtttggaaacggcgggcgcggaggtaatcggcttatccagcgtgcctttaaaaatagtacgtacagaccatttggtcggatcgttgttgctcaaatcaaagcggtacatattcccgccgcggtcgccggcataggcgatatcgaccgtgccgtccaaatctttatccaccaacgtgggggacgaaagcccgcccttgccgtcgggtacgttgattgttgcaatcggcgtaccgttgttgttttccaaatcatacacatacagcgcggttttattctcgccgttgttaatgtctttagtcgcataaccggaggcgatgaaggcggcgtatttgccgttgtgggttttgccgatttgcggcgtaccgacggtgtagcctaatttcacgccattgtcgtttttgacatcaaacatggaaacgccggccgggttgctgttgtcgattttgcttaaatccaaggcgtatgcgcctctgccgccaaagcccattgcgccgaacataaagaagtgtttttgcttgtcttggtcatctgtaatgcggcgcaagacaaagccgccgtccacgccatagcggtcgcccacatagcctttttcggcaaaggtgcgcagctctttggcaagggtggattcggtgttttgaatatccttgcgcggcatcgtgccctttcagacggcagcagcttttggattaccggcgaagacgcgcgtgccgacgtacaggttttgcgtgccgaaagctgcgcggtgctgaccggcatcggcacggtgttggcggacaatccccggctcaacgtccgcgcttttccaactttgcgccaacccgcacgcatcgttttagacagccgcctgcgcctgcccccgaacagccatttggttaccgacggacaatctccgacctacatcgccacactcgaacgcaacgaagacagactgcacccctatcgggaacacgcacacgtccgcatcctgatgccgtctgaaacggcagacagcaaaatcgacctgcaccacctgatgcgcctccttgctgacgaaggtttcggcgaaatcatggtcgaagcaggctccgaactcacatccg

SEQ ID NO: 38115 - DNA, 1379 bp, Neisseria meningitidis
tcaaggcattttttttcgattttgatagtctgcaacttgaaacaaaacctacaatattgtcaatatcggcaattcccccatcaaaatccgccaaatcaaaaatataaaaagggatgtcctcgatgggcatatcgcgtattacttgttcaatccataacttgaattcatttaaatcaatagactgagagaataagcatttaattgcaaatcctaaatcatcactatcctcttttatgattttccacataattatcttcctttgccgtcaaacgctcttttagttacccgctttatatcaaaaataccgtctgaaagccgaatatcgtttcagacggcattttgactgtttaaagcgggggcagttctacaaacggaaagaaatgctgaaatttctgataaatttcaggatgtttctctaaagcttttaatgctttttcttttgaaataggcggatcatagacatctatcccccttaagaaggcaatgccggtcaaggcattttttttggattttgatagtctgcaacttgaaacaaaacctacaatattgtcaatatcggcaattccccatcaaaatccgccaaatcaaaaatataaaaagggatgtcctcgatgggcatatcgcgtattacttgttcaatccataacttgaattcatttaaatcaatagactgagagaataagcatttaattgcaaatcctaaatcatcactatcctcttttatgattttccacataattatcttcctttgccgtcaaacgctcttttagttacccgctttatatcaaaaataccgtctgaaagccgaatatcgtttcagacggcattttgactgtttaaagcgggggcagttctacaaacggaaagaaatgctgaaatttctgataaatttcaggatgtttctctaaggcttttaatgctttttcttttgaaataggcggatcatagacatctatcccccttaagaaggcaatgccggtcaaggcattttttttcgattttgatagtctgcaacttgaaacaaaacctacaatattgtcaatatcggcaattcccccatcaaaatccgccaaatcaaaaatataaaaagggatgtcctcgatgggcatatcgcgtattacttgttcaatccataacttgaattcatttaaatcaatagactgagagaataagcatttaattgcaaatcctaaatcatcactatcctcttttatgattttccacataattatcttcctttgccgtcaaacgctcttttagttacccgctttatatcaaaaataccgtctgaaagccgaatatcgtttcagacggcattttgactgtttaaagcgggggcagttctacaaacggaaagaaatgctgaaatttctgataaa

SEQ ID NO: 38116 - DNA, 732 bp, Neisseria meningitidis
taccctcaggattggcatattgatcccgataaccatttctccaacaaccccgactttgtggactcctggccgccacatggggttgttggcaccgacgaagctgagattcatccggcgatcgctaagattcctgtcgacgcacgggttaagaaaggccaatacgctgcagcctattccgggtcaatttattaagcttcctatcaacctcccatctcggtttcgcatcaaacacaggcttagccttaggtataccgccccccgatttacccacactgaacaaatctatagagaactgaacatattccgcagcctgctccgacagccccaactgcttcaaggcctgaaccgcaatcgtcggtcgttgctcgctggctttttttccgaagtttttcgtcccagtaatgacatgatcgtaggaagacgttacaccaaccaaagcggcggcacagcctaagccgaaagtctcggcacaagatccgcctccggctactcctgaaagaacaacccccaaactgcccgaaacgatttcagccccgggtgagatgtagcggtgcaggatacttttgtcttccctatccagcttttcgtattcagccttcaaataagaggctactaaatcaggatgtttagttaggtaatataaggattccttttttaagtccttaaacctactgtcaaagcgtttgtcctgggtaaattcgataatgcgtcctatattttgacgacattccg

SEQ ID NO: 38117 - DNA, 346 bp, Neisseria meningitidis
tcaatacagtttcaaaatggaaaatgatacgttcactttggattttagtggtcttgttcaagcatttaaccatgtcacagaagctaatccgcaaaaagcttttgtggatttggccgagatgcttgcatatggcgaacttcgttcttggtatgaaggccgaagactaatgaccgattatgtggaggaggcatcacaagcaggtaaatttgaagattaccagaaagtgttgggtcaggagaccgttgcattattagctaaaacatcgggtacgcaagcacatgatatcctgcacaatgtatgctttggtcataataaaaatgtttctttatatggcaatcacaggaac

SEQ ID NO: 38118 - DNA, 116 bp, Neisseria meningitidis
ccgcgcttgaaacgtccgcttgcagatactacagaaagagtgtttcaaacctgctctatgaaagggaatgttcagttctgtgacttgaatgcaaacatcacaaagaagttcctgag

SEQ ID NO: 38119 - DNA, 237 bp, Neisseria meningitidis
ggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggggg

SEQ ID NO: 38120 - DNA, 522 bp, Neisseria meningitidis
caacagtcgcactacaaaagccaccgcgcgccgtacccgcccttggtataatgtggacgtgtccggttattacacggttaagaaacactttaccctccgtgcgggcgtgtacaacctcctcaactaccgctatgttacttgggaaaatgtgcggcaaactgccggcggcgcactcaaccaacacacatatgtcggcgtttacaaccgatatgccgcccccggtcgcaactacacatttagcttggcaatgaagttctaaacgtccaaacgccgcaaatgccgtctgaaaggcttcagacggcattttttacacaatccccgccattttccatcatccccgatacaccgtaatctcgaaacccgtcattcccgcgcacgcgggaatccagtccgtgcggtttcggtttttttgaagtttcgggtaacttctaaaccgttattcccgcgaaaacagcagtcaaaaacagaaacctcaagtcccgttattcccgatcagacgggatctacggcgtaaaatctaaa

SEQ ID NO: 38121 - DNA, 185 bp, Neisseria meningitidis
cgccgcatcgggcaatttgccttttttcagtccggcttcgagtttgtcggatgcaagtttcaagagtctgtcgtgtgtgtcgttgtccataaagggcagttgtccggaggtggatttttgtgccagttctttaaaaaggttgccgaagctgtttttgcggtaactgttgccgttgagggcgggat

SEQ ID NO: 38122 - DNA, 597 bp, Neisseria meningitidis
tcgactctagtagatcccgcgatggcccttccatacagaaccaccggatcactatgtcctgctttcgcacctgctcgacttgtcggtctcgcagttaagctaccttttgccattgcactatcagtccgatttccgaccggacctaggtaaccttcgaactcctccgttacgctttgggaggagaccgccccagtcaaactgcctaccatgcacggtccccgacccggatgacgggtctgggttagaacctcaaagacaccagggtggtatttcaaggacggctccacagagactggcgtctctgcttctaagcctcccacctatcctacacaagtgacttcaaagtccaatgcaaagctacagtaaaggttcacggggtctttccgtctagcagcgggtagattgcatcttcacaaccacttcaacttcgctgagtctcaggaggagacagtgtggccatcgttacgccattcgtgcgggtcggaacttacccgacaaggaatttcgctaccttaggaccgttatagttacggccgccgtttactggggcttcgatccgatgctctcaaatcttcaattaaccttccagcaccgggc

SEQ ID NO: 38123 - DNA, 101 bp, Neisseria meningitidis
gcggcaatgccgtctggaaaagcggataccgccctgctgttgtacgggtgcggcttctatttgcgccgttgcggcaactttggcaactttggcaactttgg

SEQ ID NO: 38124 - DNA, 467 bp, Neisseria meningitidis
cccgcaagtggcgagggggcaagcaaagagccgaaagacaggggggaccgcagacaggggcgaaagcaggagcggggagggcagaagccaggggggcggcaacaacggaagccgcaggggggaaggaacgggggcagcagcggccggggagcgaaaccggcaggggcaggggcaaaagaagccggagaggaagacggggagcagggcagaaaaagagcagcagaagacagagcggccgaagcagagacaacgggggtgagtgtgggacggacccaaaacccggggggcgctggggcgacgagacggaaaggcagaagagggccaaccgaagcaaaagcacgggaaacagcagccagcaaagccggcggcgcgagggggggggccaaggccggacaagctcggaaagagagccaaagacacagcggcaaagagaaaaaaaggaggagggagaagcgggggggccagga

SEQ ID NO: 38125 - DNA, 723 bp, Neisseria meningitidis
ccaatgcaggatccgagccgagtatgcaacctacaccacagctggcggatttgcacaaattgaaccttgtgatgctgggtgatgaagcgcaccatttaaacgcgcaaaccaaaggcaaaaaacaaggcgaattagatttagaaaaggaaatgaacgaccgcaccagcaatgccgaaattgaacgtaaaggctgggagcatatggttttggaattgttactcaataaaaatggcaatcatagccaaaatgtgctgttggaatttaccgccacgctgcctgaaaatgccgatgtacaacaaaaatacgctgataaaatcatcacaaaatttggcttaaaagaatttttgcaaaaaggttataccaaagaaatcaatttggtatccagtacgctgggtaagaaagagcgagtgttacacgctttattgtttgcttggtatcgacatcgaattgcgttgaaatatggcattgccaatttcaagcctgtgatgttgtttagaagtaagacgattgatgaatcaaaagcggattatctggcatttttaaattgggcagaaaatgtgcaggcggttgatttttcgtttttaactacattttcaacaagcttgaacgatagcgatagcgataacgccaacgaacaaggcaaaacccgcactgaacaagccctaaaatttatgcaggaaaaaggcgttgagtttgcacatttggcagattgggtaaaacaga

SEQ ID NO: 38126 - DNA, 455 bp, Neisseria meningitidis
ttcggacattccttaaattacccgtgtatcgctgtaaatcttagagatggcggaatatagcggattaacacaaggcattactgcaatgctcaggattccggtacagggtcatcgttgcacatttagccaaacggccgtgaccgatttcacggcgtttcggtgcgcccatgcggcccacttcgccggtagagtacggcggaaagttgtagtgcagcataaagcggtcggtgtattcgccggacagcgcgtcgatgatttgctcgtcgcgcgaagtacccaaagttgcaacggccaaagcttgggtttcgccacgggtaaacaatgcagaaccgtgcgtgcgcggcaatacgctggtttggatgttcagcggacggacggtgcgggtgtcgcggccgtcgatgcgcggttggccatccaaaatttggctgcggacgacatcggcttccaagtgtttg

SEQ ID NO: 38127 - DNA, 707 bp, Neisseria meningitidis
  misc_feature (624)..(624): N is any nucleotide
gcattgtcttgttgcccttacttttagcatcttgtatcggcggcaatttcggcgtgcagcctgttgtcgaatcaacgccgaccgcgtaccccgtcaccttcaaatctaaggacgttcccactccgccccctgccgggtcttcggtagaaaccacgccggtcaaccggcccgccgtcggtgcggcaatgcggctgccaaggcggaatattgcttcctataaacaagacggtacggaaattcccgacaagcatcaggcagaggagcatctgccgcttaaagagaaggatatcctgtttttagacggtacgctgaaagaacaggctgacaaacttaaaaagaaaatcaacgaacggtattctgatgtgagggttatcacatcgaaaaaagaagaagaaaaatatcaatatcaatttgtccgtgcgggctatgtgtttaccagggcggaaggaaaggataatgaaaaagaaaagacttctgatggtaaggagtttgttaaccgatttagttatgacggttttgtatattattccggagaacgtccttcccaatctttaccgagcgcgggaacggtgcaatattccggtaactggcaatatatgaccgatgccaaacgtcatcggacangtaaggcggtttycagtacggatttgggttataccacatattatggtaatgaaattggggcaacttcttatgaggctagggat

SEQ ID NO: 38128 - DNA, 110 bp, Neisseria meningitidis
acatggcattcggacttcatgcgttcgtgcgcggcttcggcttttcagacggcatatttgacgttatgattaaacagttaacaagatttatcacaacgccgtcaagagac

SEQ ID NO: 38129 - DNA, 491 bp, Neisseria meningitidis
  misc_feature (401)..(401): N is any nucleotide
acttcagcctcccaagtaactggcattacaggcatgcgccaccatgcccaggtaattttttttttttgtatttttagtagagacggggttttgccatattgtccaggctactcttgaactcctgccctcaagtgatccgcttacctcagcctcccaaagtgctgggattacaggtgtgagccaccatgcccagccatccttgttattcaaccctaccacactttaaaatctctgacagggagtaagtatgcaaaacgctcccatccggtcaggcgcagttctgccacgaggtcaagataagcaggcagttcgctgcgggtgccggagaagaagacaaatggcggccgcaccattgccatcaggcgcagaaactctaccatgccgaagtagttcatcgcgtncccttttccccggcggcgcggctttggtttgaacgcgcgtcgtgctgcctgcctttcagttcgctgatatacgcctgccggcagtggtgg

SEQ ID NO: 38130 - DNA, 815 bp, Neisseria meningitidis
cctgcagtttctcgatatagccttctgcatcggtacgggtatgtaggttgtaaccgggtttgtagaggccgtttttctttatccaacgggcatcgctgtccttactcggtgtggtttgaccgctgatttgtccttcttcgtcaacttctatggcctgacgctgtttgctgccggcggtctgaataatggtggcgtcaacgacggcagcggatgctttctctatttttaaacctttttcggtcagttggcggttaatcagttccaacagttcagacagggtattgtcttgcgccaccggttgcggtacggcataaggtgctgtaatcggggatgctcagttcgtcaaaacggcaaaacaggttgaaatcgatgcgggtaatgaggctgtgttcgagttcgggatcggagaggctgtgccattgtccgagcaggacggctttgaacatggacagcaggggataggcaggacggccgcggtggtctctaaggtaacgggttttttgacggttcaggtattgttcgatcagctgccaatcaatcacccggtccaacttcaatagcgggaarcggtcgatgtgtttggcaatcatggcttgggcggtttgytggaaaggtgctcttgagaaatcccctaaatgtcttggtgggaatttaggggattttggggaattttgcaaaggtctctagatgagtgaaaaagaagtgcaggctgcctaaaaagacagaaaaagtctttccggcagcctgcactttggtttcatttcagtcagtaaacccagtaaacgacggtctgaaaacgcagaacgttacgaaaa

SEQ ID NO: 38131 - DNA, 354 bp, Neisseria meningitidis
gctttgccgtcaagcgcgccgccagttgatttggttgcgcgcgtggtttgggagaagcttgcggaatacgcgccaatacgtcgcctttaccgatttcctgaccttcgcgtacggtaatcaccgcaccaacggggaatgccatggataccggagtagaagtaccgggaatacagatttccacgccgttttcgtccaagagtttcacagtcggacgcagcagtgtcgtcttcttgagaggaacgacgtttaccgtcaatcaccaccaaagtggacaaaccggttacatcatcggtttgtttggcaacggtaacgccctcttccacgttttcgaatttcaccatacctgcgtgttcg

SEQ ID NO: 38132 - DNA, 282 bp, Neisseria meningitidis
caaaagtttttcaaatgaaacggttgcggcatcgggcggtgtcgacgttgatttggttcccgtgtggtaggggaggaagcggcttccttcaaacctgcctttgattgctgttgtgcgcgcggtgatggggaatcgggagaggtcggcggtatgtgtgccgccggtattgtcgattgtgccgctgttttttcccgtctgcctgatgcggacaagggcttttccgctccgcaaaccggcaagcatggggacggagataaaatcgtcgggaataccgtagatcgg

SEQ ID NO: 38133 - DNA, 301 bp, Neisseria meningitidis
gaaacggttgcggcatcgggcggtgtccatttgtatccgccgtccttcgggggcgcggttgatgttgacgcagattccgctgcgtttgaccgatgatgttcgcgcggtgatggggaatcgggagaggtcggcggtatgtgtgccgccggtattgtcgattgtgccgctgttttttcccgtctgcctgatgcggacaagggcttttccgctccgcaaaccggcaggcatggggacggagataaaatcgtcgggaataccgtaaatcgggaagcgggcttgtgccgtccgcctgtcgtcgccc

SEQ ID NO: 38134 - DNA, 384 bp, Neisseria meningitidis
catcgggcggtgtccatttgtatccgccgtccttcgggggcgcggttgatgttgacgcagattccgctgtgtttgcccattatgttcggctgcgggataagcaacatttatgagcggctaaaaatgggacgccggtattctcgattgtaccgctgttttttcccgtctgcctgatgcggacaagggcttttccgctccgcaaaccggcaagcagggggacggagataaaatcgtcgggaataccgtaaatcgggaagcgggcttgtgccgtccgcctgtcgtcgcccttcagcaccggttcgtaatagccggtaaccgtaccgtcaaggcttccgttgcctgcaacctgccacggcgtgaaatagcgttcaaaaaactgttttg

SEQ ID NO: 38135 - DNA, 476 bp, Neisseria meningitidis
  misc_feature (332)..(332): N is any nucleotide
  misc_feature (363)..(363): N is any nucleotide
cactgtgccgccgctttgcccgtcggtgcggcaagcgcgatgttgggaagattttcgtcttcaccgcaaatcagcgccagcagtttggcaaccgttgtcgttttgcccgttcccggcccgccggtaatcaccataaaagactgcaacagtgccaaggcggcggcatcgcgctgcccttcgctgcccgtgccttgaaaccattttgcgaggttttgcctcgcgcctgccgcgtcgggggcggatgtgccggctgccgccaagcgttttatctcggcagccaaatcgtattccaactgccacatcctgcccaaaaacagccttctgccttccanaatcaaaggcgcggcggatgttccgacaacnggtgcgagtgccgacagcgcgtcagcctcgccaccgctcaaacggatattgaacttttctccactgcggtctacgcctgcgactgtgataatgcctttttgagcgtctttttc

SEQ ID NO: 38136 - DNA, 589 bp, Neisseria meningitidis
caggcaggttcggtcggttgcagccacttcaacgactccggcttctggctggtcggccgtctcttggacatggacgtaccgaccacgctgaaaacctggacggtcaaccaaaccctcatcgcactcatcggctttgccttgtccgcactgctgttcgccatcgtctgacagacggaaaggatagtaaatgactacgcattttgtcgttatgggcgtatgcggctgcggcaagaccaccgccgcgctgtccctgcagaaacacctcggtcaatgtccctatgccgaaggcgacgagttccacacccaagccaaccgcgacaagatgggcgcgggtattccgctgaccgatgaagaccgctatccgtggttgggcaatctgcgcgactggatgacgcaacaggcgcaaaacggtgcgaaccacaccatcgtaacctgttccgcccgtacgaatgaccgtttttgcaatgcctgaaacaggcgttcggtgcagtttgcaagcacttcgtcgccggaacccgcatagtgttccagaaaacggattgccgcccttgccgccgcttgggcaaattcatctgtctgccgttccatt

SEQ ID NO: 38137 - DNA, 549 bp, Neisseria meningitidis
actggaaagtgcgcatcgaagatgccattgccgccgacgaagtgttcgttacgctgatgggcgacgaggtcgagccgcgccgtagcctttatcgaacaacaacgcgctgattgcccaaaatatcgacgcataagtgccgttttaaaaaaggagacgggcatcgtgccgcgtctcctttttggttggtcaaacggaacctgtgccgtctgaaaaaccgtcggagcaaaatatgatcagcattttcgatattttcaaaatcggtatcgggccttccagttcgcatacggtcggcccgatgaaggcagccgccgcctttgcggcaggtttggatgcacaggctgttcgcatcgtcatcgacatttacggctcgctcgcactgaccggatacggacacggtacatttgacgcgctgacaaacgcggctaccgcgacattctgcgcggagccgaaggcaaagctgccttcatccacctcagtccgccgcaagacatcaacctcgagcgcatgatgtcgcgcagaggacattacatgaaagcagggatgctcgat

SEQ ID NO: 38138 - DNA, 564 bp, Neisseria meningitidis
cggcatgcggattgaacatgatgatgtcgcggtctttaaacgtacctggttcgccttcgtcggtgttgcaaaccacatatttttcgcccgggaaagaacggggcataaagctccatttcaaaccggtcgggaagcccgcaccgccgcgcccgcgcaaaccggaggttttgacttcgtcaatcacatcggtttgcgagatgttttcggacagaattttacgcagggcggtatagccgccgcgtttgacgtattcgtccaatgtccagcaatcgggattggcggtatccacttggtcaaaaatcacgcctgattggtaaatagccatttttggtgtgcctgtttgttttcgtatcggttgcggtcgctgtttcagacgaccttaagatgtctttgtgtaccggcttgtaacgtcgtctgaaataaaatctagtttatcaaatcgctcggtttggaaggcagcctgccgcacgacatcccgcttgccggcattcccgaacgcctcgaacgcatccgcacgcagcacatcctccggctcaacgggcaagaaatcggcttcatccccga

SEQ ID NO: 38139 - DNA, 522 bp, Neisseria meningitidis
  misc_feature (452)..(452): N is any nucleotide
  misc_feature (483)..(483): N is any nucleotide
cgaaagcgggaatgccgaatccgtccgcgcggaaacctgcatcccgtcattcccgcgaaagagggaatctagaaacgcaaagctgcaagagtttatcggaaatgaccgaaactcaacgaacctggattcccgctttcgcgggaatgacgggggtttggcgggaatgacgagggtttgggatttctgtttttgaatttctgtttttgtgagaatggcaagattttcggttcttgtatggataacgagattttagatggcgggaatttgtcgggaaaacagcaatctgagacctttgcaaaaataatctgttaacgaaatttgacgcataaaaatgcgccaaaaaattttcaattgcctaaaaccttcctaatattgagcaaaaagtaggagaaatcagaaaagttttgcacgatattttcagacgacctttaatcgtttttgttggatctcgnacacttgcttgtctgtcgtcattcccgccangcgggaatccatcctcaatggtaagcaatgtcttattaa

SEQ ID NO: 38140 - DNA, 585 bp, Neisseria meningitidis
cggcaataccgataacggtcaaatccacataacggttgttggcaaatgcttggcgcaccatcaaatgcgccagcgagccttgtccgaacaaatcggccgcctcggcatcgctaaatagttgcaccggctctaaggcgggctgtatgcccgcggtcagcatgggtgcaaccatcaataccttttgcggattttgcggcaaaccttgtacggcattgcgggtgttaaattcaatatactgcccgggcacgcggatgctgcccggaatcgtgtcaaaatcaatatggggcatcattactctcccttagtattgcgggttttggtatttggggcggcatcctcaaccaccaccaaatcgccgtcatcaatcatgcggcggtaatacaggctgttgccgtccaactccaccggctcttggccgatatattcgtgcgggttgtgttttttgaaaatgagattgagcataaaattttagtaacctatgttattgcaaaggtctcaatctttaccgtcattcccacgaaagtgggaatctagaaacgcaaagttgcaagaatttatcggaaatgaccgagactcaacgaacct

SEQ ID NO: 38141 - DNA, 974 bp, Neisseria meningitidis
gggcgttgattgcgattgtagggtttgtaggctggaaaagttacggcatttttaaagtttacagcawagccacagacagccggattgagcaggaagcgcaaaaagaaagcgttgtgcagacgatgacggagcagcctgcatcatcagaggaaatgcctttaaaaaattcagacaatttgaaacctgaagactttgtgccgactttacccgaaaagcccgaaagcaagcctatttataacacagtccgacaagtaaaaacctttgagcaaatcgccggatgtatagacggcggaaaatcagattgcacatgctattcaaatcaaggaacacccttgaaagaaataacaaagataatgtgtaaagaatatgtgaaaaacgggttgcctttcaatccttataaggacgaacagcaaaggacggaacaggtggaacagtccgcgaaagcggacaagccgcaagttctcgtaatgggcggaaagccgtagcaaaatctcatgtacgacaactgaagagcgcggaaaaccgtttgaaggaattggcggcggagtcgtaaagcagaaagttcaatccctacccctcaggatggcttgagctgagtgaagggggttaattgctagaatggctgttttttttaaagtgtctcagtctggaatcgcttcgttcgggggttgtaggtgcaggaaaatatggcagaaaaaaggaaacgggggaagctttgtaaagattgggcgcgctttttacccaatctttatgaatacccccttttccttttttatgaactgtttttcagtaccggtaactctcgaacggagtgattcgagactgagatacgcccattgaaaatcagacattcgggtcgcatcagaaacctttaccaagacctgcgaccccaatctacggcaacggcgacaatatgcccgatgagaactgctgccgttgttcgacaaaatcaatttgcagcaaggcaagcattt

SEQ ID NO: 38142 - DNA, 485 bp, Neisseria meningitidis
ccgccgaagcaatcgaggcggcgtggatattgttggtaatcaccctcaggctgccgcgccgcctgaccagctccgacaccacggcctccatcgtcgtgccgatactgacaaacagcgacgaaccgtcggggatgtgttccgcaatcagccgggcaatggcgtttttttcgttttgacaccgggtttggcggtcggcgggcaggccctccggcaagtttccgcccgaagatgcgccgccgtgatggcgtttcaggctgccgacctcctccaactcgcggatgtcgcggcgtatcgtctgcggggtaacgtccaatgcggcggcaagctcgtccaccgacataaactgatgccggcggacaaggcttaaaatctctccgtgcctttggattttcggcttcatcgttttctgaaaatcagatacggcaaaggcgataagcttcaagccctgaatgagtagatcagcccattgagggcttggcgtttga

SEQ ID NO: 38143 - DNA, 579 bp, Neisseria meningitidis
  misc_feature (410)..(410): N is any nucleotide
  misc_feature (527)..(528): N is any nucleotide
aaatcccgtttattcccacaaaacagaaaatcaaaaacagcaacctgaaatcccgtctttcccgcgcaggcggtaatctgaacacgtccgtagtgaaacctatatcccgtcattcgcacgaaagtgggaatccaggatgcagggaaaaccgttttatccgataagtttccgcaccgaaaggtctagattcccgctttcgcgggaatgacggcggagggtttttagttttctcgataaatgcacatcatccaaagtcccgttattcccacaaaaacagaaaatcaaaaacaacaatctgaaattccgtccttcccgcctgtgcgggaatccggcttgttcggtttcggttctttttctcgtttcgggtgatttctaaaccgtcattcccgcgcaggcgggaatctaggtangcatacggctttgttccgcaaccatttgggccccacgcccgaaaaactcgccaccctgcgcgagcagctcggtctgttggggcttcaacttggcggcggcgacaacccgtcgccgannagatatgccgcgcttgtcgaacattcaaaggcagactgatgccgaattgct

SEQ ID NO: 38144 - DNA, 580 bp, Neisseria meningitidis
cgccctttgaatttgcccccataatgcagccttgcccaagaccaatgccgcattctggttcagattcacattgccgttaatctgtgtcgctccaaagctgtttaaagccttatcggataagttgcctgtgttgcaggtaacgtaaccggtatagtccgagcgcacgcaaacctcatcgccgtttttgtaacccaaatttactttggcgttgtctgttgcggtgatgttggcggtgatgtcggatacatttctgccggaagagaatgatgcggattgattaaccgcaatttctgtggctttgaatgtgcggtttatccagtcgtcttcaaatacgacttcattgtttttggagaaatgtgcgtcttttcgggctgaagatttgttcacaaaatctcttgcgtgtggtgttggacgacctgataacaagacattgccttgatctttaagcttcggtttttcttgataaattcttgccgcattaaaattctagattcgcgctttcgcgggaatgacggcggagggttttttgttttcccgataaatgcacatcatccaaagtcccgttattcccacaaaaaca

SEQ ID NO: 38145 - DNA, 623 bp, Neisseria meningitidis
caacaacttcagcgcctgcattataggcagcatcaaccatttcaaaagctgtttttaaagagccttcatgattgatgccgatttcacagataatcaatggttcgtggttgtaacctactgaacgattaccaattttaaattcgttgttgttttgcatttagctttccttgtgattaagaatgttttctgcctgttgtaaatcaagctcagtatcaatatcgatagagtcttgatgagacataatataaagtttggttggggcgataaaaaaacaattatttgcaattagtgaagcagtatcattaatgtaaattgcaccattaggcctaaatgcctgaggtaattgttggcgaggctgctccaaatcgcttagatggcgcatgggggcatattcgccattattgatttgaagcaaggtttttagtggatgatgctccacaaatacgcacttgcctgccttgttgataatgttgtcgtgaatatcggaataattgacatagttgagcataatgccctgatcgcggctgccgacggcgatattgtcgaatactttgagccgctcggaaaacatcagcacatagcccatattgttgcccacggaaatattgccgctgatttcgctg

SEQ ID NO: 38146 - DNA, 533 bp, Neisseria meningitidis
cacggatgacgcgcgtacggatttcccgggtggcttcttcatagattaaattgcccgccgcgccggcagtggagtccaatacatcgaccaaaggcacgcctgccgcaatcagcgtcgccgtcgtcgtgccccagcgggcaatcgttcctttgcggacaatgtctccgaaaatcggcatacgcagcagtatggcatccatacgccgttggattttaatcgaacgcgccttcaatttaaggaagccgtatatggcaaagcccagtgcgatcagcaccatccagccgtatgagacgaaaaagtcggacatatccatcactgtttgggtcagtgcgggaagctccgcgcccatattggcgtaaacttctttaaaggcgggcagtacgaaaatcatcatcacgaataccaaaccgattgggcatgcagagacaacggatccttttattttctcatcaaatagagaaaaacttcacgaatatgagcccctgtgcgtaatggactggttggttgtaataaggttactgtgccggaattac

SEQ ID NO: 38147 - DNA, 597 bp, Neisseria meningitidis
  misc_feature (451)..(451): N is any nucleotide
cacgaagcccgcgcggaacgcgtctgccacaaacagcatacgttcggggccggggttcgccagttcgcggcggatttccgctttgtcttcactgcgcggattgaagccgcacaagcctgtttccaagccgcgcagggctttttggaaactttcttgaatcgtgcggcccatcgccatcacttcgcccaccgatttcatctgcgtggtcaggcggtcgtctgcggcagggaatttttcaaacgcgaaacgcgggattttggtaaccacatagtcgatggaaggctcgaacgacgcgggggttttgccgccggtgatgtcgttgcgcaactcgtccagcgtaaagccgaccgccagcttcgccgccaccttcgcaatcgggaaacccgttgctttggaagccaacgcggaagaacggctcacgcgcgggttcatctcaatcacaaccggttcngattgcctgcgcccccgccttgccgctgatgaatcgtttcggcaggcattgattcctttttcaaataccgatgccgtttgaaagatgttcagacggtatcttccgaacagacagatgaatatggtttccaaactggacaaatactg

SEQ ID NO: 38148 - DNA, 459 bp, Neisseria meningitidis
cactacgttcaatttcggcattgctggtgcggtcgttcatttccttttctaaatctaattcgccttgttttttgcctttggtttgcgcgtttaaatggtgcgcttcatcacccagcatcacaaggttcaatttgtgcaaatccgccaatgtggtttgattttcccgccgggtgcgaatatcgttatacagcttttgaatgctggtaaatttaatttcaatgccgtctgaatgtgggctaaatgtctccactttgcgaataggaattaccgtatcgccctgcaaaatcttctcggtaaataaaaattttgcgtgcgtcggatcggtaaaattaatttccgttttatccacgatattgttttgattcacaaaaaacagaaaatgccgataacctttttcaaaataatacaaacgcaccctgctgatgaacgatttggacagcttggatattaccgggccga

SEQ ID NO: 38149 - DNA, 577 bp, Neisseria meningitidis
  misc_feature (573)..(573): N is any nucleotide
agcggcacggtttgaagcggccagcctatgccgactgtcgggtcgttccatattaaaacctgttcggcttcaggcttgtaatagtccgtgcatttatagacgaactcggcttcatcgctcagtacatagaagccgtgtgcgaggccttcgggtacccacagttggcgtttgttttctgcggacagaatttcgcctacccatttgccgaaagtgggggagtctttacgcatatcgacggccacgtcgaatacttcgccgacaaccacgcgtacgagtttgccttgtgtgttttcagtttgatagtgcaggccgcgcaatacgcctttgccggatttggagtggttttcctgcacgaaggtgcgttcgcagacttgggttttagaccactcgtcgcggaaggtttccataaaaaagccgcgcgcgtcgccgaagatcaacgccgccatcatcatcgttttgccagcacctgttgccatattgaacagcaaatgcgttggcttattttttaaatcagggaaatcgtctagctttgaagtgcggtcaaaaatcaaaaagttttcaagggcagatttntgcc

SEQ ID NO: 38150 - DNA, 492 bp, Neisseria meningitidis
  misc_feature (331)..(331): N is any nucleotide
  misc_feature (352)..(352): N is any nucleotide
  misc_feature (414)..(414): N is any nucleotide
cggcttcgaccgcgccggtgtggtcgggatgtgcggacagatcgactttgtgtttttcgccgtttactttgaatgtgatgtaggcatcgggcaggttgagtttttcggcaaggcagctgagcaggacttcgccgctgccgttatccaggaccgcgcctttgagggacgagctgccgcagttcaaaaccaagatcaatttttgggacattttcttactccggaaagtttcagacggcattggaatcggacacggatactaaccggattcgtgccgaatccgttttgccttcctgggcgggaaagtagtggggccgtctgaaaaggttgatanaagaacaggctattctagcanaaatctttgcaattgcttggcttaatcgggcgtttgcgtgaaaatggcggaagtcacttggngctcaagcagttttacgtcaggaatggcggtatcaatgatgttcatctttttatctttcatctaaagggcgtctgaaa

SEQ ID NO: 38151 - DNA, 654 bp, Neisseria meningitidis
  misc_feature (644)..(644): N is any nucleotide
aattcaagaatcaataggaaggttaaaaaaggataaaacttcttttataatttctcatcgtctttcaattattcgtgatgcaacattaataatggttattaatgatggtaaagtacttgaaatgggtaatcatgatcagctgatgaaacaaaatggattttatgcacgtttaaaacaatcttcggttcgttaataaattctaatgactgttgctgaaattaaaaaacttgcattaaataatcaggtatttaatgaagcaaaagcgcttttagaaaaaggtaatgttatttttccgggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagagcggtttgcgtattgggcgctcttccgcttcctcgctcactgactcgctgcgctcggtcgttcggctgcggcgagcggtatcagctcactcaaaagcggtaatacggttatccacagaatcangggataacgc

SEQ ID NO: 38152 - DNA, 218 bp, Neisseria meningitidis
gcggtcgcgcccaaacagcccatttcaccttcgtctttttcattttgtcttttctcccaataagcccattttccatcatctcgattttgcccaaaagtaaaaacggtggcggctgattgggcgcaaacgcccaatgtacaactttaatcgcccaaaaatttatgccaaaaaacgcaactttaaacacgtacattgggaggtcgcgcccaatcagcctt

SEQ ID NO: 38153 - DNA, 120 bp, Neisseria meningitidis
cgcaaaaagctagcgcacggcgctgtttctgcgggtcgatatcgagcggccgcagcctaagcttgacaggaatattggccttaagtgacagcatcggcaaatcgttgacagcccataggc

SEQ ID NO: 38154 - DNA, 528 bp, Neisseria meningitidis
tccagctcggtagcaatacgaattcgagctcggtaccaggttacaggagaaacagatttaagaggttctaatattacagccggtaaaaacttggttgtcgccaccaccaaaggcaagttgaatatcgaagccgtaaacaactcattcagcaattattttcctacacaaaaagcggctgaactcaaccaaaaatccaaagaattggaacagcagattgcgcagttgaaaaaaagctcgcctaaaagcaagctgattccaaccctgcaagaagaacgcgaccgtctcgctttctatattcaagccatcaacaaggaagttaaaggtaaaaaacccaaaggcaaagaatacctgcaagccaagctttctgcacaaaataatgacttgaattccgcacaaggcaatcaaataaccggttccgatattacggcttccaaaaaactgaaccttcacgccgcaggcgtattgccaaaggcagcagattcagaggcggctgctattctgattgacggcataaccgaccaatatgaa

SEQ ID NO: 38155 - DNA, 368 bp, Neisseria meningitidis
tgagcaatttaattgccgctcggtaccctaacatattgccgccaagcggtatggaagcggaaataatggtaggtgggcttcagacggcatccgccctccccgtcattcccgcgtaagcgggcatccagaccttgggatagcggcaatattcaaaggttataaaagacccgtcattcccgcgcaggcgggaatccagaccttgggatagcggcaatattcaaaggttatctgaaaatttagaggttctagattcccgctttcgcgggaatgacgaaaagttgcgggaatccagaacgtcgggcaacggcaatattcaaaagccgtctgaaaatttaaaagttctagattcccgctttcgcgggaatgac

SEQ ID NO: 38156 - DNA, 479 bp, Neisseria meningitidis
ccgtcaaataggactgcagtgaaagtcattttgcgccctccttatttttccaacgcaacggtgtggctgccgtcgagcgtgatgtctttgccgtacacctgcaaatcgagcgactcgcctttgagcagagtgaagacgacgttttctttgccgacggcgactttaatcagacggccgcggtagttgatgtggaaggcgtagcctgtccacgcactcggcaggaacggtgcgaagctgagtttgccgccccaggttttcatttgggcgaaaccttggacgatggcgagccaagagccggtcatggaggggatgtgcaggccgtcctcggtggcgttgttgtaattggccaagtccaagcgggcggtgcgctgggacatttccacggctttttcgtccttgcccaattcgggggcgagaatagagtgaatacaaggcgacagcgagctttcatgcacggtcaacggttcgtagaagtcgaa

SEQ ID NO: 38157 - DNA, 759 bp, Neisseria meningitidis
gcacaacttaattatgttgcctgaaacatcatataaaagataataaaaggtacgcagccatgaattacgcaaaagaaatcaatgcgttaaataacagcctttccgatttgaaaggcgacatcaacgtttcattcgaatttttcccgccgaaaaacgaacaaatggaaaccatgctgtgggattccatccatcgcctgcaaaccttgcacccgaaatttgtttccgtaacttacggtgcaaactcaggcgagcgcgaccgcacacacggcatcgtcaaacgcatcaaacaggaaaccggcttggaagccgcgcctcacctgaccggtatcgacgcttctcccgacgaattgcgccaaattgccaaagattattgggacagcggcatccgccgcattgtcgccctgcgcggagacgagccggccggttatgagaaaaaaccgttttacgccgaagacttggttaagctattacgctccgtcgccgacttcgacatctctgtagcagcatatcccgaagtgcatcccgaagcgaaatccgcacaagccgacctgawtaatttgaaacgcaaaatcgatgcgggcgcgaaccacgtcatcacccaattcttcttcgatgtggaacgctacctgcgcttccgcgaccgctgcgtgatgttgggtatcgatgtggaaatcgtccccggtattttgcctgttaccaacttcaggcagctcggtaaaatggctcaagtaaccaacgtcaaaatccaagctggctgtc

SEQ ID NO: 38158 - DNA, 737 bp, Neisseria meningitidis
cggctgtcttcattggcgtacggcgcgctactgctcacaccggtactacccgaaagttatgcagcaagcgtaggacgtgtcttcagcacgcacgcgtctgaacagtatacagagaatctgaatatttactgcataacaaatgccgtctgaaaaattgtgagcttttcagacggcattgagccgtaaatcatggaacgcgtgcgcgctgaagcacacaccttacgcatggattttaggtttcatgcaggctacagcttgcttccataaatcatttttatcagagctcgtaggtacggttaagcttttagggttagccggtacaatgtgaactccatttttacctgaatgaatcgtaccaaaattggtacttaatcctgatttcccatcgctgcctataggatacccaaaatcaacaacaggatttcctcttgctcctttagaaataactggataagcacctgaatgtattccgttcaacaattcttgaggattaatgttttgatttaaagtactcttaccttcaatgtagtttctatgtcctgaaatatgtttcccttgagctccatcatgaattttagtcccaatagattttgctttaaaatcaacattgcgggtttgaaacatttctccatctacagactgagataatcttgaagcagtgttatgcctgtaggagtctgagaaatccccactaaccgcagccttccccggttttggcgcctttgtcaggtttttga

SEQ ID NO: 38159 - DNA, 1089 bp, Neisseria meningitidis
gacggcgagcataatgtcgctgtcgtattcgttcatctggcagccgaaggtgcggataaatacttttttcatggttgtgtctttctcaggcagccgtaatcgcggggctgattgttgttggaatgaaaaaatttcagacggcacgacgatgccgtctgaaaatcggtgcggattatagcacgatgtgggttttggaggcaggatattgttttaaaatatgaatttaatcggtcgggacggctgtataatgtttggctttaatgggagatgtgtatgaaaccggctgtatgggcggcattgctgctgtgtgcgtgtaccagcaatttcggcgacagggaacatcagttcctgcgttatagtggattaacaaaaaccagtacagcgttgcctcgccttgccgtactatctgtactgtctgcggcttcgtcgccttgtcctgatttttgttaatccactatatcagacggaagagggaatcgcactggattgagccgaaatgccgtccgaaaacagcagaccgatgccgtcattcccgcgcaggcgggaatccagaccttgggataacggcaatattcaaaggttatctgaaagtccgagattctggattcccactttcgtgggaatgacgggatgtaggttcgtgggaatgacgtggtgcaggtttccgtatggatggattcgtcattcccgcgcaggcgggaatctagaacgtaaaatctaaagaaaccgtgttgtaacggcagaccgatgccgtcattcccgcgcaggcgggaatctagaccattggacagcggcaatattcaaagattatctgaaagtccgagattctggattcccactttcgtgggaatgacgggatttgagattgcggcatttatcggaaaaaacagaaaccgctccgccgtcattcccgcgcaggcgggaatctaggtttgtcggtgcggaaacttatcgggtaaaacggtttctttagattttgcgttctagattcgcactttcgcgggaatgacgaagagttgcgggaatgatggaaagctatgggaataacgaagggttaaagtaatcacgggatggtgttcgcgggaatat

SEQ ID NO: 38160 - DNA, 394 bp, Neisseria meningitidis
ggtttcgcttgttttaagtttcgggtaacttccacttcgtcattcccacgaaagtgggaatccagttttttgagtttcagtcatttccgagaaattgccttagcattgaatgtctagattcccgcctacgcgggaatgacggattttaggttgggggcatttattggaaaaagcacaaagctgaaagtcggcattcccgcgcaagcgggaatccagtgcgttgagtttcagctatttagaataaattttgggactctaatcgcgtcattcccacgaaagtgggaatccaggacgcaaaatctcaagaaaccgttttacctgataagtttctgcactgacagacctatattctcgcctgcgcgggaatgacgaatccatccatacggaaacctgc

SEQ ID NO: 38161 - DNA, 452 bp, Neisseria meningitidis
ccgggcgaagtcatcgccggcgcgctcggcagagacctcaaacaatgcgccgtttacggccgcgaaggccacaccggtccgcgcgatccgtcgaccatcggctttgccaccgtccgcgcaggcgacatcgtcggcgaccacaccgccctcttcgccaccgacggcgagcgcgtggaaatcacccacaaggccagcagccgcatgacctttgccgccggtgccgtccgcgccgcagtttgggtcaacggcaaaacgggtttgtacgatatgcaggacgtactcgggctgaacagccgttaacccccatacaaaatgccgtctgaraagatattgttcacacggcattttgccgacaggctccgtatcggcatatcaatgtttcagcacacaggacgacgcataaagcgtcgccctatgtgttgccctgagtcggcacgggttacgcccctccc

SEQ ID NO: 38162 - DNA, 102 bp, Neisseria meningitidis
gtccgatgtctgtattgattccagatcagtcaccattttttgggagtcttcaatggttatatcgccaaattcttttccatgagctttgaactgtccatttaa

SEQ ID NO: 38163 - DNA, 257 bp, Neisseria meningitidis
tggttttgggtgggtcaaacaactcctacttacatggatcggcaaaacgacgatcaccaactgcaatcacttcgtcaatcaggtaacagtcaaactccaccgccaacgacagcgcaaaagccaaacgcgctttcatacctgaagaatagcgtttcaccggctcatacaaatattgccccagctccgaaaattcttccgtaaacgctttcacataatcgatatcgacattgtaaatccggcagatgaaacgcaaattg

SEQ ID NO: 38164 - DNA, 312 bp, Neisseria meningitidis
tccctctggcctgaaccaagcccgaaattatacctgcaacatccgacacaaacaaaggcatttcaatatttttatttctatgaaataaaagcgtgtaagcaggcttacacgcttttatttggctggggaggaaggattcgaaccttcgcatgctggaatcaaaatccagtgtcttaaccgcttgacgactccccaaaaagggctggctggggaggaaggattcgaaccttcgcatgctggaatcaggatccactgtcttaaccgcttgacgactccccaactcgcttgacttggctggggaggaaggattcg

SEQ ID NO: 38165 - DNA, 308 bp, Neisseria meningitidis
ctcgagggaattgaccggcaattcttcaagcaataaacaggaataccaattattaaaagataacttagtcagatcgtacaataaagctttgaagaaaaatgcgccttattcaatctttgctataaaaaatggcccaaaatctcacattggaagacatttgatgacctcatttctttcaatgaagggcctaacggagttgactaatgttgtgggaaattggagcgataagcgtgcttctgccgtggccaggacaacgtatactcatcagataacagcaatacctgatcactacttcgcactaatttccc

SEQ ID NO: 38166 - DNA, 181 bp, Neisseria meningitidis
aattccccgaggaattattcgataaagataagcttacattatgaagagcagcatattacagccgtatgggtctacttgacagtaaaatttgaagagcattggaagcctgttgatgtagaggtcgagtttagatgcaagttcaaggagcgaaaggtggatgggtaggttatatagggatata

SEQ ID NO: 38167 - DNA, 192 bp, Neisseria meningitidis
  misc_feature (15)..(15): N is any nucleotide
gcagtcgacagtagnagatccccacccgtaccgatgcagaaggctatatcgagaaactgcacattacccccgccaatgcccatgagtgcaaacacctgtcgccgttgttggaaggtctgcccaaaggtacgaccgtctatgccgacaaaggctatgacagtgcggaaaaccggcaacatctggaagaacatc

SEQ ID NO: 38168 - DNA, 562 bp, Neisseria meningitidis
cgataaaaacctgcgctatcacggcctgatgcagggcatttcgcgcgaaaaatccgacgaaatcttcaactacatggaaaaattcgccggctacggtttcaacaaatcccacgccgccgcctacgccctgatttcctaccagaccgcatggcttaaagcgcactaccccgccgaatttatggcggcgaccatgtcgtccgaattggacaacaccgaccagctcaagcatttctacgacgactgccgcgccaacggcattgagttcctgccgcccgacatcaacgaatccgactaccgcttcacgccgtatccggacatgaaaatccgctacgcgctcggcgcgattaaaagcacgggcgagcccgccgtcgaatccatcaccgccgcgcggcaaagcggcggcaagtttaccggtctgttggacttctgcgagcgcgtcggcaaagaacacatgaaccgccgcaccctcgaggccctgatacgcggcggcgcgttcgacagcatcgaacccaaccgcgccatgctcttggcgaacatcgacctcgctatggacaacgccgac

SEQ ID NO: 38169 - DNA, 703 bp, Neisseria meningitidis
attacgtatcgaggcattcgagctcggatacccgggttaatatcagattttggagcagtaaaatttattatgtacactaatccaaaacaaaatcaaatattgaaaactagatttattttcgaataaatagaaagccgtcttatatatagtaataaattaataaccctgtttttcctattgcctttattgtgccatgcagttgagtttgatgaaactcaatataacgactgtaaagataaatctatgttatgtgctgtcagaattgattctcccaaaggcaataactatagtggattaacaaaaatcaggacaaggcgacgaagccgcacacagtacaaatagtacggcaaggcgaggcaacgacgtactggtttaaatttaatccactatataaatctatgtggtttgacaatggcaagttagtatttatatcctttactaatcaacaaatggaaaatcaaagtcgcccatctctagcgatgtttattagtgatgacaaaatatccagtaccaatattgatgaatttttagcatctttcgatcctgataaatatcgaatatttcatgatccaagatataaatttttacctagtatgtcgaactcattgtaatccttattctctttttgatattgatagcaaatataaacctgatgagaaagataaaatctttttttcaatcacgacagataacacagattttt

SEQ ID NO: 38170 - DNA, 512 bp, Neisseria meningitidis
gttatccaaaggaggctgtcgaaggcaaggcatgaaatcgagcagtccgtattgtttgactttgtcgtggtcaatgacgacttggcgcgagcggaggaggatttgcgccatattgtgaatgcctgccgtctgaaaaggtcgcggcaactggggtttattgcagatttgttggaaaattcctagaaaacggcgaaaatacccggtttcccaatttaaatatttttgaaagaaagcaaataatatggcacgtattaccaccgaagactgtaccggaaaaatttccaaccattttgacctgacattggtaacggctcgcggggccggcaaccttgaaaacggcaacacgccgcttgtggacaatgtccgcactaccaaaccgaccgttaccgccttaagggaaatcgccgccggacatatcggtacagaactgttgacgcgcaataaataaattctgccggaaacgcacgccggaacactttgccgccgtgcagtccgacggtttgaaatgaaaa

SEQ ID NO: 38171 - DNA, 517 bp, Neisseria meningitidis
ctttggatgaagatggtgtaatgcacgctttggtcggacgggtcgaaatgcgcgctttcgacttgcccgaccataaaattttcatacaaaacagggctgttgacgttgaggatgcggtcgtttttaccaatcaaattcaagcgcagcccgctttgcccgatggcggtaacgggcggaatgtcctgcacttggaacacgtcttttgcctcgtcgcttttgccgggtgtaaaggcgatgtacgaacccgaaagcagcgtacccaaaccggttacgccgctttggtcgatacgcggcttgacaaccaaaactgggtaaccctgcggataaggccgaatacttcggcattgatttgggcggttacttcaacgcctttttggtcgtcgcgcagtttgattcgggtaacgcgtccgacatcgatgctcaatactttgatgaccgtattgttgacctcaatgccttccgcgctgtccatcaggagcgtaaccacaggccccctgttgcggatttccttaaccca

SEQ ID NO: 38172 - DNA, 674 bp, Neisseria meningitidis
ctcggctaccctgcaaattccagattcccgtctgcgcgggaatgacgattcataagtttcccgaaattccaacataaccgaaacctgacagtaaccgtagcaactgaaccgtcattcccaccacttttcgtcattcccgcgaaagcgggaatccagaatctcggactttcagataatctttgaatattgctgttgttctaaggtctggattcccgcctgcgcgggaatgacgaatccatccgcacggaaacctgcaccacgtcattcccacgaacccacatcccgtcattcccgcaaaagcgggaatctaggacgcagggttaagaaaacctacatcccgtcattccctcaaaaacagaaaaccaaaatcagaaacctaaaatcccgtcattcccgcaaaagcgggaatccagtccgttcagtttcggtcatttccgataaattcctgttgcttttcatttctagattcccactttcgtgggaatgacggcggaagggttttggttttttccgataaattcttgaggcattgaaattccagattcccgcctgcgcgggaatgacgattcataagtttcccgaaattccaacataagcgaaacctgacagtaaccgtagcaactgaaccgtcattcccaccacttttcgtcattcccgcgaaagcgggaatctag

SEQ ID NO: 38173 - DNA, 105 bp, Neisseria meningitidis
gaatgacgattcataagtttcccgaaattccaacataaccgaaacctgacagtaaccgtagcaactgaaccgtcattcccaccacttttcgtcatacccgcgaaa

SEQ ID NO: 38174 - DNA, 403 bp, Neisseria meningitidis
ccgactacgatttacttataaaaaatggacagacagtaaatggtatgcctgttgaaattgcaattaaagagaaaaaaatagctgctgttgcacagactatttcaggttctgcaaaagaaactatccacttagaaccaggtacttatgtatccgcagctggatagatgatcacgttcattgttttgaaaaaatggctctttattatgattatccagatgaaattggggtcaaaaagggtgttacgacagtgattgatgctgggacaacaggtgctgaaaacattcatgaattttatgacttagcgcacaagcaaaaacaaatgtttttggattagtcaatatttctaaatggggcatcgttgctcaggacgaactcgcagatttaagtaaagtacaagcgagtt

SEQ ID NO: 38175 - DNA, 386 bp, Neisseria meningitidis
aaatcagagaagctactgcgaaagttgctgctgaaaaaggtgatcaaaatggataagcgttcggtgctatgatggattaaattcgttggaaactgatttagacagttcagtgacacaattaagagaaattaaagcagggctccatgagttggtagaaaaaaataccacgttggaaatcggaaaccaacgcttacgagagcatctccaagaactgaataagttagcaggaaatacaactgaaactgaaaaacaagagctatcaaaatctcgtatgaatttggaaaaactttatgaagagggcttccatgtctgcaatattttatatggttcaagacgtgaaaatgatgaagaatgtgccttttgtcttgatgttatttatggggaac

SEQ ID NO: 38176 - DNA, 379 bp, Neisseria meningitidis
cctgtcgacccagatggttataaaatcgaagtcattcgtgagtgttaaaaagtttcacttgttcacttactgagctttttgtgtttgagagctgtccgagacaaaacttgtctcgacttcttctcaaacacttttttcaaaaaaagtgctacaatagaacgtatgaatttattgaggatgtgatgttattatgacaaaaaaaattattggaatcgctggcaatcaacttttgcaggcagctgaagtgtttcacggtaaccaagtgacgtacaccccacaaggttttgtcagcgctgttcaagccgcaggtggcgttcctctcgttttgccaattggccccaaagaattagccgctacgtatatacaacaaattgataaa

SEQ ID NO: 38177 - DNA, 395 bp, Neisseria meningitidis
ccggtgagttgctgcttttaatatactctcatcttttattgtttctgcttcttgtattttgctttcatattctttttctaattcttttacttgattacttaaagttaaactcttttcattgataatatcttcgatggaattatttactgaatcttttaatttatcagtttgtcgataaagtccgtataattgtgtaaaagtaaaaaggccatataacagtccttttacggtacaatgtttttaacgacaaaaacatacccaggaggacttttacatgacccaagtacattttacactgaaaagcgaagagattcaaagcattattgaatattctgtaaaggatgacgtttctaaaaatattttaacaacggtatttaaattttccaaaaaaaccc

SEQ ID NO: 38178 - DNA, 368 bp, Neisseria meningitidis
ccggaaagaaaaaaatattactttagttgagttaagtgaggagttaggtattccacgttccactcttaataggtatgaaaacgaagatagcgaaccaaaacaagaaacttgggaaaaattagctgattattatggtgtttctacggcttatttaatggggatatccaaccaaaaggttagcgaagaaaaagctttgacggccgcaaagaaagtttatcaagtctatctttccgacgacgatttaggaaaagaaattcgaaaagctctaatgtattttaataaaaatgatttagatagtgtcttaaaacaagcaatgcagcagtattttactatcccagccgttgaatggaatacagaatttcaatctt

SEQ ID NO: 38179 - DNA, 372 bp, Neisseria meningitidis
tgcgccgctgattctaaatcattttgtaaatcgtcgttcagggataatcgctgctattttccaagtcgtttttgcgttatttatcttttataattctatcggcacaaactcgttgacggttattctgattatgtacttattctcaggatttctagcaacagttgttaaacggaaacggatgagtgagcaagttttcccagctttaatgtgggtagtggtctttcctgttttcatggcggttgtcttaatgatttatcaagggatgagtttaacagatggtaaaacgtggacagctttaatttgtgcaagtgcaggaacggtactttcatttttagcaacaatgggcttgcatccatatatcgaattattagt

SEQ ID NO: 38180 - DNA, 378 bp, Neisseria meningitidis
ccggcctatcgatttccccacatttacagttggcaactggcggtggaagcgttatgcccatagtggtctatttgatttggataaaaaaatcaaggactattctcctgaagagttagcattatttttatatgctccacaacaaaaactagctaatccacccaaagagtggcctcatacagctttgtatgaaggaatcgtcccgcgtatgcaacgtagcatattgcatacagacgaaggcaaacgtcatcaaaaataccttaatcactttgttaccgtaaaaagatgtcctgattgtttaggaagtagagtcaatgaacgtgttcgtagctgcaaaattaatcagaaaagtattgctgatgctgttgacatgccactcac

SEQ ID NO: 38181 - DNA, 359 bp, Neisseria meningitidis
attcccacctaactcgttaagcaccgaagcttcaatcaagcaagggtgcatttattttgcttccttagtcaatcgagcaaaggatatcggttgtgatcaagagagcatcattcaatcgtataactatggtggtggatatttagactatgttggaaaaaatggaaagaagtacagctttgccttagcggaatctttttcaaaagaaaaatcagatggggaaaaagtgacctattcgaatccaatcgctattaaggagaatggtggttggcgttataactatggaaatatgttttatgtaatgttagtgaaacaatatcttactacaacgaagtttgatgataaaaccgttcaaggaattt

SEQ ID NO: 38182 - DNA, 360 bp, Neisseria meningitidis
cggagttttgatgaagattgttatcaagagtgtatgattaggttatatttagctttgaaaaagtttgaaatacgtgaatgatacatttttgaaataacagactccgtctaccactctttattattactgttcaaaagatatgttcaaatacacttaactacttttgtaaaaaaatataaaaaatactgaaagattacttcattttattaatttaaatctattgaatcatgtagaggtggcgttaaccatgtatttatttttattaggcatgtttataggatgtttgcttggtataacgattttaaattgtttagccattgcaaaatatgatgatatgagttctggaagaaattagctctt

SEQ ID NO: 38183 - DNA, 296 bp, Neisseria meningitidis
ccgaatttttctttttacatccgaaggtttactacttcattattaagatgttcccaaacaatttgctctggcggtgccgttttattataaatacggtaaacaatacgatctaatgatttcccaagaagtgatttccccgacacctttatttgtactgttgcctgatcgtctacaactacggcatcaacatagaaatagagcccttccatataaataacagtgtctggaacaaatatttgtatatataaaggtgtcaaaccaacaaacagctcaaacgttgaataggtatagtaatt

SEQ ID NO: 38184 - DNA, 376 bp, Neisseria meningitidis
cctgattttagctttatcgaaaaaccattaattacgaaaggagcaactcgtgaagaaattattcaggatcaattggttttagctggggaccctgccaatcagaattggttggtacgtgaaaaggattctggggtctttcattatacccaacagtatttagaagaaagtaatcaaagcccaacactcatgacggttaaaaacaatgaaatgattgttaaaatgttggaattgggcatggggcaatcgttgctttcaagaaaagcgattactgaaaaaattcctttccaaacgttaggtgaaaagtattggcgtacctttaatttattaacacggggacatttaaaatcctccttgcttcaagaagtaaaacaagcaa

SEQ ID NO: 38185 - DNA, 371 bp, Neisseria meningitidis
cctactagaagcaatcgcgcaatatcatcggtatgcaagcctgttgttggttcatccagaatataaaagtttttcccattagaatttttatgaagttcactcgctagcttcatccgctgtgcttccccaccagataaagtagttgccggctgccccaatgtcacatagcctaagcctacatccacaattgtttgcaatttacgatgaattttaggaatatgtttgaaaaattctacggcatcttccaccgtcatatctaaaatatcagaaatgtttttgcctttataatgaacttctaacgtctcagaattataacgtttgccatgacaaacttcgcaaggcacatagacatcaggtaaaaagatgcattt

SEQ ID NO: 38186 - DNA, 372 bp, Neisseria meningitidis
ccggggctttcaaattggctagctctgtttctttttcagccaacagttgttcttgtttagccaattcgtctttttgcttttcaagcatctcagctggaattcctggttgttgctccaactgcgcaagtgcttgttttcccgtttccagcgcttgccgaccttggttaatgtccggctgagccgaatcacgcagagccgcaacctgttcttctggccgatttttcagtgcctcttttacttgatttaaggcctgctctcttttcttttcataatcagaggaatacgtattttgatgttttaatgaacgaaatgagattagcaattctggataccgttgactgtcaaaggctttttccgaaaccacgccaaaaa

SEQ ID NO: 38187 - DNA, 363 bp, Neisseria meningitidis
ccgaattggagggtaaacctttttcaatttttgttaatgcaggagagaaagttactaccgaaacattattagccgaagttgattttgatcaaattaaacaagcaggaaaagatccatctgtcatagttgtttttactaaacctgaacaagttaatgaagtcatcttaaatagttatacaactatatatggtgattcgtgtggtaaaattatactttgacgtagagttaagtatgttatcggattaaatttaaatgaataaaaggtgattatagactgtgagttatagaatttaagtaaattatattaacaaaacaccctactattatataaatcagtagggtgttttctacttatccgaactt

SEQ ID NO: 38188 - DNA, 397 bp, Neisseria meningitidis
  misc_feature (1)..(397): N is any nucleotide
ccgttttgcaattttactacgttacttaccagtgaaaaaacatttcccttatttaattcttggttttactgtaactgctttactaggaacaatctttacaaacatgcaacttttaggaacatctgttgcgagcgttgtgaaagacttcagtggtgtatttaacgcactaccaatgttagcagtcgctttaattggtttcgctttagccgcaattagctacaaaaatggtcaaatgattccgagtgggccagcagccaaaaaagaacatgcagcgaatgattcagacgaaggagagattgaagatgacgaaatctaattataaattgacgaaagaagattttaaacaaattaatcgcagaagcttgtttactttccaanttaangggggggttttttt

SEQ ID NO: 38189 - DNA, 371 bp, Neisseria meningitidis
  misc_feature (365)..(365): N is any nucleotide
ccagccattgcagtcgaagaagttgattttttaacggaaacaattaaagaaccgaacgcagtagtagttccgtttctttcaaaaagaggcgtataaagggaggaagaaggaatggaatttgtaatcattttgctgaagtcattgcttattggtggtttactaggttttgcagctggcgcaggcgctgctcggatgtttcatgcaccacaaacgcaagggttaggggcatttagaacattaggagaaatgaacgcggcacaaggagatccagcatcacacttttcttttggtttaggttttttctttaatgcttgggcttcggccgtcggagcaggggcctttacacaagatgtgacccaccgganttgttt

SEQ ID NO: 38190 - DNA, 379 bp, Neisseria meningitidis
ctgaagattatcatcatgttaaatatacagatgaagcgattaacgcagcagcaaacttatccaatcgttacattcaagatcgctttttaccagataaagcgattgacttgttagatgaatctggttcaaaaatgaatctaactatccaactcgtcgatccaaaaacaattgataaaaaattagcagaagcggaacaacaaaaacaacaagcttccgcagaagaagattttgaaaaagcggcttattatcgtgatcaaatcaataaattacaagcaatgaaagaaaaacaaatcagcgatgaagaaacaccagtcatcactgaaaaagatattgaagccattgtggaacaaaaaactggcattcctgtcggtgacttaaa

SEQ ID NO: 38191 - DNA, 361 bp, Neisseria meningitidis
cctgtgaataatccagccaaattaatcgctttaactgccttaagttctgtgggaattaacttactagttggcgaacaatatttgtcaattattttaccaggggaaacatttaaatcctcatttactcgtttaggtattgataaaaaatatttaactcgtactttggcagatgctggggcggcagtcaactcgttaattccttggggagttagtggtaccttcattatgggaacgttaaaagttggtgcactagaatacttaccatatgcctttttcccattgctttgtcccattatcaccgtcattttggggatattcttaaaaaaacaacaaggggaaaacaaaaaagcaccagggacta

SEQ ID NO: 38192 - DNA, 362 bp, Neisseria meningitidis
cgagggactttacaatcagttggtcaggttgtcgccagtgccaatatggtcaatgagaacgcagttcaacttgcgatgctctttaaaattatgcggattgtcctactcgtagcagttgtctatttatttggacgtttcaagcaaagtaagacggcagaatcagaggctgagttggtagaagtcaccaaaaaaagcagcgccctaccttggtatgtagttggctttttcattgcctgtgtctttaatagtttgattcatttccccgtcgtgatcagtgagactgctcatttctttagttcttggtttgaaattactgccttggcagcaatcgggttacgactcgattttaaaaagtttttcca

SEQ ID NO: 38193 - DNA, 378 bp, Neisseria meningitidis
ccggcgcaccaacttggaatggccgagaatatgtacaacgcttaatcgcagctgcaggtatcaaacaagactataggacgtcattagcccaagctcaattaattaattggtgtatgttcaatgggcaatggttaggacaagtaagtccattaacagttgatgaatttaaagttgtcagctcgcctaaaacagctgcttatgcgtttgaattaaactttgaacgtccagctgcagcacatccagaaagacaaacctatgcacaagcatggtatgacaaattcaaagatttgaaagcttctactgcaacaggaaaagctggcatagaacatttggagaccttaatgggcaaatggcttggtaatgggcaatgttatgccg

SEQ ID NO: 38194 - DNA, 359 bp, Neisseria meningitidis
cgaactggttgccaaagaactctaccaagactcgactgcagcagttaatcgaacttttccatataaagagcaactttttaccattgttggcgtgacaaccaataccagcggtgccattggtccaggtaatgatgactcattgctttattttcccaaaaagacctatgaacattatttcggcaagctaaaagatacatctacgttgaaactaacagtagcacctggctatcaaccagatcaagtattgaaagaaacaataaaaactctctctcaacaaggaaccatgaaaaacagtgggacgtatcaagaatataatgttaaagataccatcaaagaaatgggctctttattaaataatt

SEQ ID NO: 38195 - DNA, 376 bp, Neisseria meningitidis
cctgattacggtcgttattatgatgccgtttatgaaacgttgaaaaatggtgcaccgcaactagtaactaaagagcaagcattaactaacatcgaaattttagaagcaggttttcttaacccaagtccaagtgtttatcatttgaaagaaaactaaagcgtatttaaatgacttgaaaagcgcctgccctacagtccagacaactgtggggcaggcgcttttatttataaagaattgtgaattttaatataagaaacgtatattgttagtaaaaataaaaaaaggaaagacatcttagtagcactacttccccaagaattgctactaaaatgtcttttgtgatgctcgctcaattgaagagccttaaataggatat

SEQ ID NO: 38196 - DNA, 362 bp, Neisseria meningitidis
cccctaagtaatggtcaattcggaaaatatcttgttcaggaaatgcagcacgaatttcttcatttaattcgtaggcagattcataatcagaaccaaatggcttttcgataattagacgatcaaagccttcttccgaaataatatgttgtgatttcaagtgattaacaatggttccaaagaattgaggggccatagctaaatagtaaacatgattgccttctaagtggtattgttcatttaggcgatcagataattcttttaaggtattataatgttccgtatcattcacattatgtgattggtaatagaaatgactagaaaattcagttgcctcttcggccgtgggatttaagtcttgaatg

SEQ ID NO: 38197 - DNA, 375 bp, Neisseria meningitidis
ccggttctttctaaaggtgaaaataaggaaacgccatcttccgttcgatgactagccaaggcataattgtttttccccatgacttgatcttctttcatggtcccggcaccagttaataaagcgacattggacaatcctttaaaaatgggcaaattaatttcgacacttggtatcgcaatggcaccaatcacaggtaagtttttgttttcaaattgggctttcatcaccgcttctgtgctcaaggactcaactgaatcaaagtcaaacgttgtttcacgagccatatttttcttcacatcagctggtttcaacttgctaacggcgtacgagcggctattttgttgaaccacccaactacgtatctgattgttaaaa

SEQ ID NO: 38198 - DNA, 370 bp, Neisseria meningitidis
ccggcgtaaataagaagaaacctttactttttttaaacaaccaagtacctatgccaaatacagctaatgaaataataatgccaacatacggattcatgcgcgaacctctcctttcgctttcttcgttgctgcgggttctttttcttttcgagcatctttcatatgcaataaaaaggcgcccgtccaaccagttgttgctagtaacgctaatgttgctactaaaataacaaaaataatttgaacgccaaattgttgcataatccctaaagaattaactaaggaaatccctgaaggaacaaataaaaatgtaataaccgttgataagctattacctagcccttccacttgctccaatttaacaactattttt

SEQ ID NO: 38199 - DNA, 357 bp, Neisseria meningitidis
agtttatctttggtcgattttccttgatatatatataatcttcaggaaatgctcctgtctgtttaaaattcggaatttcagaaattattcttttttgctaaactagttataactggttagtaaaaagaagtattggacgaatagtgctgaaacaagtgaatgatccaaagtataaagaaaaatgaaaccgataccacaagacaagactgttgctgaaaatggtaagtgatcattctgctaagtttagtgtcttaatgtttagttaactaagaattgttggattgtactttagaaagaagggacaatatgaagcgaagtaaatggaaagaattgatagtaacgggcatctgccatata

SEQ ID NO: 38200 - DNA, 362 bp, Neisseria meningitidis
ccctgttaaatcgtcttcatatttttccatttctgtaagtgcaatagctttaggataatcgaagctagttaagtaaagatgcgcattcggtacttgctttaagtcctgaatcatctcatccacatctttagttgctaaagctgaaaataaaatatgaatcgtgtgttgtggaaactctttgcgcaagttttcaactaagcgttttactgcatgatcattgtgggcaccatctaaaacaatcaacggttcatcactaagacgttccattcgagctggccattgcgctttagccaacccttgagtaatgtctcgttctttaaatggcaaatgttgtagttggcaatacttgtcaaataattgaa

SEQ ID NO: 38201 - DNA, 354 bp, Neisseria meningitidis
cggaacgaatgatgcctgaagagcgtttattagtgatgcgccgtttatgtgcgaaagatactccagcctttatagtatccagaggactagaaatccccgaagaattaattacagcagcaaaagaaaatggcgtttctgtattacgttcaccgatttcaacttcccgtttactaggggaactatccagttatttagatggccgtttagctgttcggacaagtgtccacggagttttagttgatgtttatggacttggtgttttgattcaaggagatagcggtattggtaaaagtgaaacagctttagagcttattaaacgtggacatcggctaatcgcagacgatcgcrtcgatg

SEQ ID NO: 38202 - DNA, 370 bp, Neisseria meningitidis
tgaccaagaaacggtggtcattgaaatggcgaaagcaacggaattgaattggttaaagcagcagaacgcaatcccttgatcacttctacttatggtacaggagagatgattcaacatgcgctcaatcatggggcaaaaaaaatcattatcggcattggtggtagcgtgacaaatgatgggggtgcaggtatgattcaggcacttggtgcgcgtttgttagacaaggaagggcaagaattgacacgtggcggtggtgcattagataaactggcgcagatcgatttaacacagtttgatcaacgcatttttgctaccgaagttctagtagcaagtgatgtgaataacccactaacagggccaacaggggcgt

SEQ ID NO: 38203 - DNA, 361 bp, Neisseria meningitidis
ccgcttgtcaatctatcactttggttgtcttcttttaaagaaggcaagatttcttctttataaagggtttgatagaattcgtttgattgtttatccaaagaagcttcatactgatttgttgctttgcgccagacaaaactgaatttattggcatccgcttcgatttttgtgccatcaatatatagcgcttcattgtcaattacctgattggtgattaattgacagcggaataagacaaaggcttctgctaaaaggtgagcagttgtttcctgactttggaagcgattgatggtccggtaactgacttgttcgtggtttgctagccaacgcatacgatagctgtcatctaatagaaatccaa

SEQ ID NO: 38204 - DNA, 559 bp, Neisseria meningitidis
aaagcattctcaaaattctctcgctataccgcagacggtaaacaagccgttggcgaaatcaaacgacattcatacggcacacccgccgaaaatctcattatcaagggcaataatctgattgccctgcattcgcttgccaagcagtttaaaggcaaagtgaaactgatttatattgacccgccatataacacgggtaatgacggttttaaatacaacgacaaatttaatcattccacttggctgacttttatgaaaaaccgtctagaaatcgccaaagagctgcttatgaaagacggttcgatttttgtgtcaattgacgacaccgaacaggcacatttgaaaatttcactggatgaacttttcggaaatgaatcatttcacctgcacttttatttgggaaaaaaagacaggtgcgtccgatgccaaacagatagcgactattacatagtttgtcttatgttacacaaagaactttaaaacagttaaattagatttaaacacgttttcatatgatacagagagatacaaattaagtgataagtttgaacacgagagaggc

SEQ ID NO: 38205 - DNA, 364 bp, Neisseria meningitidis
ccggcaatccatatgtgatgggcgcaattttaggtgctattatcccgattgttggtatgacaccgttaagttcaatggttttaactgccttgattggtttgactggtgtaccaatggctgtcggtgcgttgacttgttacggcagttccattgtcaatgcggcgctatttaaaaagttaaaactaggcacagcttcaaccccgttagctgtggcaattgagccattaacacaagtcgatatcatcagttccaatccaattcctatttacgcaacgaatttattttcaggaatggttagtggcattgtagtgaccttctttggcttaaaagtacctgtracaggaatggcaacaccgtgggcttg

SEQ ID NO: 38206 - DNA, 375 bp, Neisseria meningitidis
ccgacatgtggtccatcacccgaggatgtaacgttgctggttggacattcaatgcttgcgtgtcttcttcaaaggctttgataaaacgctccgccacttccggcgcagtaattttcaattctttagctgccttgataattttatcatcgacatctgtaaagttcgagacataattcacttcatacccacgatattcaaaataacgacgaatcgtatcaaaggcgatcgcactgcgcgcattaccgatatggatatagttatacacggttggtccgcagacatacatccgaactttacgcgcctcaattggcgtaaatacttctttttctctggtcaatgtattataaattttaatcatgccctttttccaccttt

SEQ ID NO: 38207 - DNA, 328 bp, Neisseria meningitidis
ctttaaaagaattcttttctaatattgatgaaattacagatttaataaaagaaaagatggatgaaactggtattaaactattgtggaatactgcaaatatgttttcaaatcctcgttatgtcaacggcgcacatactacaaataatgcaaacgtatacgctatcgcagctgctcaggtaaaaaaaggtttagatgtttcaaaaaaattaggtggagaaaattatgttttttggggtggacgtgaaggatatgaaacattactaaatactgatatgaagtttgaacaagataatattgcgcgtctattcaaaatggctatattttacgg

SEQ ID NO: 38208 - DNA, 375 bp, Neisseria meningitidis
cccgtttcactcaattacaatctctaccaaccaagtagcggaccatctaattgatttagggctggttagttcctttgatatgtgtaatcagcggattttaccttttattgaatccgttagtaaaaatgcggcccttaacagtttgctaaattatcgcgatcctttaggtacgcactttcaacgagcaaccgctgccgaatggcttcagacacaaggcgttcggaccaatgccgaagaagttgccattgtatctggtgtccagaatggactggccgtgacgttagccgccgctttttctccaggtcagcggattggcgtagatcgatacacgtattcaaattttattgaactcgcacagctttatcatttagaaat

SEQ ID NO: 38209 - DNA, 358 bp, Neisseria meningitidis
cctgaattagttatgatcatttctacgccagctattaaacttgtgacgactgttcctattgaatatgtcattttttttattgttcagcatcttttttatctagtggtaattggggtgattgagtttatacattgtttgtttacattctttttgaaacgaagagtgaaacaaattaatagtctcaaagtgataggtgatagtttattaatgatttttgctactttttatttttttgattttcgttatggtttagaattatttctagcaaaccaattgtggagtatctcctatatgattcctatcactttttttctaatagtggtatgtttaatgcttattagtataggcctattaagac

SEQ ID NO: 38210 - DNA, 375 bp, Neisseria meningitidis
ccttcaatttttactgtttagcttaagctgatttgaatagagtatcaatttcttcccacggggaaaagtcgaagagaccaatttctcttcgactttctttgtataaagcagaaacaacttcgattcctttaatcgttactgcagctgtataggtggactgaaagttgttgccataaggaagcttccccttcaactgtcggtgatcctgttcaagaatattattgaggtatttcgacttccaatgcttcactttttggtatagaattccttcttctttcagctctttgatcgcttttaatgaaggagcatatttatctgttacaatggaacgtggttgaccgtagactctgattagacgcttgaaaaagagcttta

SEQ ID NO: 38211 - DNA, 365 bp, Neisseria meningitidis;
  misc_feature (361)..(361): N is any nucleotide
ccagaaatcatgacaatgtgaaagtatcgtatgcctcattggaacgctatttagaagatattcatcgcatggtggaaaatggtttactttctgaagaaaaagaattttatgcgcctgtgcgcttacgtggcgggaaacaaatgtctgatctgcctaaaacaggtattcgctatatcgagttgcgtaatttagacttaaatcctttttcacgtttaggcattgtggaagatactgtggatttcttacattatttcatgttgtatttattgtggacagatgaaaaagaagaagcggatgaatgggtgaaaactggggatatttttaatgaacaagtggctcttggtcatcctcatgaaacganttaa

SEQ ID NO: 38212 - DNA, 380 bp, Neisseria meningitidis
  misc_feature (376)..(376): N is any nucleotide
cctccttggcatggcaactactggaactgatggcaaatacacagtgactttagagccagggaaggcctcagctaacgaaacaataactgtcgtagcgaaaaatgcaacaggaaaagaaagtcagccagctacagcaactacaccagtcgacttagccacaccaaccattgattctattaccggaaattctagtaaaggttacgaaatcactggaacggcggagctaaaaaccactattgatgtccgtgacgcagacggaaccatcattgctgctacaactgctaacgaaaccggccaatatacggtgactctaccagctggcgtagtgacaccaggagaaacgattacgattattagcaaagatggcgcaggtaantgaa

SEQ ID NO: 38213 - DNA, 375 bp, Neisseria meningitidis
ctgcttaaaaatactgttttagtgagtttaggtacgaatggtccttttacagaggcacaatttgatgaatttatgaaagcgttaggtaatcgaaaagtttattggattaatgttcgcgtcccaactagaagatggcaaaatcaagtgaatagtttacttagtcaaatggacaaaaaatacgataacttaacggtcattgactggtttaattatagtaacgcccatgatgattggttttatgatgaccgagttcatccaaatgtggcaggtggcgagcaatacacacactttatcgcggagaaaattttacagtagcaagaaacttccagctcagatgaaaggggctggaagttttttgttataggaaaagcaaat

SEQ ID NO: 38214 - DNA, 362 bp, Neisseria meningitidis
ccgtggaaaaacttttgttaaagctagagctaatagataaacgaatcgaacgcacattatttcgacaaaaacattttgagcggttttgggctactcttaagcctttagagcaacaattgctcattaggcgattcaagtataaagaagaggttaattgccctcacaggcttatagagagcgtattagatgagattgaagagatagaaacagctatttgtttgatggaaaatatagaattagaagaaaacgagctttccgacgatgtagaagaaaacttagagaggatgtgtgacttctttgctttatgaacgtatccgtccagagtttcatcttgcacgctggatatattacgaaaaagcacg

SEQ ID NO: 38215 - DNA, 375 bp, Neisseria meningitidis
cctgatcctaaaaacggctttgtttatagcttcctcatcgttgaaacaattcaaaatggtgcagaaatctcagcggggaaattagcacccaatgaactaggtgtcacagctgtggatgattatacattaaaggtgacgctcaaagagccaaaaccgtactttacgtccttgttagcttttccgacatttttcccgcaaaatcaaaaagtagtcgaacaatttggtgcggactatggaactgctagtgataaagtcgtctataatggtccgttcgtggtaaaagattggcagcaaacaaagatggactggcaactagcaaaaaataatcgctattgggatcaccagaacgtgcgctcagacattatcaattataca

SEQ ID NO: 38216 - DNA, 360 bp, Neisseria meningitidis
cccccattttagaacggatcatgaatcaatatcaagaaatagctgcggctttacgccaagcgttgccgcaaatttttccgcaaaagaatctatcggaagaggaaattgcctacatggtgcttcattttgccaattctttagaacggagtcccaaaattatggaagttgatattgctggtttttctcctagcggtttggcttcgacaagtatgctggaaatgcgattacggcgctactttccttttatcaaccagattcatttttttcggattgcggatttaggtaaggtgaatgttgaggaaaactatgacttagtgatttccacttcgttattaccaggatacaatggtaaatataaat

SEQ ID NO: 38217 - DNA, 377 bp, Neisseria meningitidis
cccgttgcgctacttgctgatgttgcttccttagcgctacttgctactgtcggactactttcaatcgtgattgtttccgcaactgcggtcgcgccagaaaaggcgttaatcactaaagaactacacaagccaatggttgctaatcgttgccacttagtttgcttcatgtcgtcccttctttctctggaccattccgacaagaccaatcaagacaagaccaagaatgctcaggtttgcctgactcttgcttcctgtacgagggagctgcgagccagctgtggtggtctgtgtcgaaccaccacttcgttgatctccttgcagaggaccagctggttccttgggatccgcagctggctcatctgttttcggtggggggc

SEQ ID NO: 38218 - DNA, 339 bp, Neisseria meningitidis
cctaagatttggcttatgagcttgggacagcgcttaaaaacgtttgtctctttgctgataagtccatttttttataacggaggtggctagagtgaaagcctgtggcattatcgtggaatataatccctttcataatggacatcgctatcatgcccaacaagctcgccaacaaagcggactgatagtagtgattgctataatgagtggaaattttttacaaagaggagaaccagccttactagataagtgggccagagcagaagaagctttgcaaaatggtgtggatttagtcattgaattgccgacagcttggtcggtacagtctgcggattactttgc

SEQ ID NO: 38219 - DNA, 532 bp, Neisseria meningitidis
ccggagcgagtacccaaaaatcgcgtgggaacttttgctgaatatattgcagtggatcaagcggctgtagctatgaagccgaaaaatttaacgtttgaagaagctgcggccattccgttagtcggtttgacaagttatcaagcgctacatgatattatgaatgtacagccaggccagaaagtcctgattcaagcaggttcaggagggattggaaccattgcgattcaattagcaaaactagcaggcgcttacgttgccaccacaacgagtagtaaaaataaagaatgggttcaagcgttgggagcagatgaagtgattgactatcggacacaaaattttgaagaagttttatccgactatgattatgtgtttgatacaatgggggggacaatcttagaaaaagctttctcagtggttaaacctcagggaaaagttgttacattgtcaggcattcccaacgaacgttttgctaaagagtatggcttgccgctttggaaacaatgggcctttaaaatagctacccgcaagattg

SEQ ID NO: 38220 - DNA, 519 bp, Neisseria meningitidis
cggaattgtatttactgcagagacagtttaaggaggacacgcaatgagcaaaggtccgttagtcactcggacagagcttcgcaaacgcagagaagcagaagaaaaagaagcggaacgtcgtcagcaagaagagcagaagctggcggaaaaagcgtataagcgaaaagaaaaagaaatttcgacgttttatcgtaaagaaaagaaaaaacaaaaaccgatcaacaagtcacgagtaggagaatactcgaagcgtcgagaacggagtacttggttaaacaaggcaattattattgtagcgattttattagccgttgtggcatatatcgttttgaatttatagaaaagaggaatcactatgaaaattggaattattggagcaatggatcaagaggtcaaaattctaaaagaaaaattgacagacacgatgtcatgggaacgagcaggcgctttatttgtttctagttcgttaggaagacatgaggtgattgtagttcgttcaggaattggtaaagtggcctc

SEQ ID NO: 38221 - DNA, 503 bp, Neisseria meningitidis
ccggggttgaaggtgtacatggagaaaaacaagttgagaaaagtgggcttaactgccctggaatggctaaaacaacatccagaaattaaacaacataaagaatcaagtctctatgaacagttgtttgctagtcagcaatggcaacaagcacaaacgatcggaatgattcggtcgttaccgctagaattatcaacacagccaattttcgaacgggccatgcaagagagcaagcaagtggcggtgccgcgaacatttaaaggaggcaaaatgcacttttatcaagtctttccagagacggtttatgataccagtgcatttggcgtggaagaacctccgttaacagcggcagaaataacagctacagcgattgatttattgattgtgccagggattgttttcaatcgtgctggctatcgaataggcttcggcggtggtttttatgatcgaatttggtacatttttcggggcattcatgtagtttagttttacgtgacactcccatg

SEQ ID NO: 38222 - DNA, 500 bp, Neisseria meningitidis
ccggaaaagtcgctggccttggcacccacgaagaattacttacttcttctaaagagtatcaagaaatcgttgcgtcacaggaggaggataccatgcaaactaaaaaaattcattttggtgccttctcacgttttaagccgtatttactacgctatccaaaagaaattattggcgccttaatcctaggaattctcagtggtttttcgactgtcctcatgacttattatataggtaaatccgttgatacaatggtgggtaaaggacaagtcaatgctgcgcaactcatcaaaattttaggtttattagcagggattttactcgtaaccgttctaagtcaatggctgattcaacgtctcggtaatcgcgtgtcttatttatcgaccacacagctgagaaaagatgcctttgcccatttaaatcaattaccgttaagttattatgaccaaacgtcacacggaaatatcgtcagtcgctttaccaacgatattgacaatatttca

SEQ ID NO: 38223 - DNA, 439 bp, Neisseria meningitidis
cgcggtcgtttataaaccattagaaccgttagacacaccaacgattcattttgaaaaattatatggacctgatcagaacggggcatatatttatcgaataaacgactagtgattcattcatggaatgaggtttgaatatgggaaaagtattgaatagaatcggtcgacttattttattagttacaatgatcggctcgtatacgatgtgggtcgtaggaattgatgcgccagtcacaaaatatatgtatgccaatagttcaattttattattaatagcagtaatacttgtactgctattaaattgtacgatattaaaatttattgactggctgaccgtagcgttggcgctagcaacctggctcttgtttcactttacggaatcaatccgtcatagcacgatgcaaacagatacaatgattcctttaattattttattggt

SEQ ID NO: 38224 - DNA, 495 bp, Neisseria meningitidis
cctgctgtgccgttgcgccagaaggaagcatcagctagaagtgcgtcaattttttcttggaaaacagaccatttttcctcaggaaattttttttcaaagcgtgtttttgccgcttttgcaaaatttttcaaaacaagcgaatctttttctacgttttgatgagcgacatgggtgttaaacaagaaagtaacaaacggtccatgaacttcttcagaaaataatgttgataagctatcttatttttgatttgccataataaaatcccccttctaaaagtaagtgtagcacaggaaatcgaatgtttaaaacaatatgttcaataaaagaaaacgcttcaactaatctcaataaaggactgttaatggtgttctaataaaagttttataaaaaatatagctgaaactcatgataaaaaaggcacaaaccactatacttacgttatgccaattatcccgaattggtatgttcatacttactcctaccaagagtacataa

SEQ ID NO: 38225 - DNA, 853 bp, Neisseria meningitidis
atctataattcctgaatctcaaagatcaattattccagttaatctattattgccatctaacaatagatgattacaactaaaatcattatggcataatcactttttaccctcaaaaactgttgttgcatttagtctttccataaaactatctatataatctttttctatatcagttaaatcattataaatagtttcacgcaacaatatatactcttctaatacattttgtttattatcaatagtacattcactaatatctgtataatctaaaccgtgcatttgtcttaaaaaactggcaatatctcgttttaacaaattttgttcttcttctgacatagtagaataaatttctggtgttaaaaaagttcctttaatttctttataacctagtatagataattcatcactaatatacgaatattcaatattaggaatttttacattagtttctaaatttgtatttaaaaaattatatattgctttttcttttgcataaccttttttcttattagtactaaattttgttttaaaaatgtattcattattaactaaatatgccacactatcataaccactaccgattatttcaatactatctactttgaaattatcaaagtaatgctcaattaaatatttcattgccttaacatttgtggcattatcatcatatctatattccattaaataacaatcttcttttttgccctcgtgtaattcatgttctggcaaatcttcaataattctaaaaccagatttttggtatgcccttattgctctatggattatttttatgagggactaaaataactgcattagcatttctttcgattttcaaaaattcaaaaatcaattg

SEQ ID NO: 38226 - DNA, 499 bp, Neisseria meningitidis
cctgcaaaggctcttacttctttgatgtctttaaactccaacttatgccctatcacatttattaagtttagcaccctttggtcagttatcccatctaaatgatctaaaaaattagaataattttcttttcctaaagcttcttgcatgtttgttttgtctaatacggattttaaatcgagtttagttgcactaacttttggatgatttaatttaataccccactgcttacttgcgaattcatccaataaatcaccaaacatctcttcatacaatttatctatgtcatcgctaatttcaggaataattggtatttcagtacaacggcaacgtccatgatacggtggatgccaatcatctttaatctcttttccatgacgtccaccacaaatagaacaaacacgctcatcttctgccgaccagctttgtgtttgcttaacacctatatcctttagcgattttcttacaccttctaccgcaaaatgtgaatattccgttctaa

SEQ ID NO: 38227 - DNA, 504 bp, Neisseria meningitidis
  misc_feature (249)..(249): N is any nucleotide
ccgattaataattttattcaaaaagcgcgtcgagcaacaaaaaccatcggacttggtggcaatggtcagttttttcggttatcaatgattaccgaacacttaggctatcagccttggggaaatgctttgttggatgactatgagttaaccattaaattaatgctgaaagagttatcgattgcttatattgacgaggcctttatggctcaagaagcactgagagatgtgaaacgttttattcgtcaacgngtcgttgggttcaaggaaatttagattgtctagcgtatttacccagggtgattaaatcaaagtcattaacgctaaggcagaagtgtggaatctattattttttagcgcaaccctttattaatctcgtagcggggatgctcgtttttgtcttaactgggcttcaactgcaacacttgtataggttaggcttttcgttatcgcttgtcattagttttgttttggccgtcagtatttcgttagttttcggcatttttt

SEQ ID NO: 38228 - DNA, 506 bp, Neisseria meningitidis
cccggtttgcaagctgcgcaatgcttaacgttagaagaagtagccaaacaaatggctgctgaaacaatcgatcaatgcctgttgcccattgagacagcagtagaacaattcccacgaattgatttatcagatgaattgtatcaaaaagtaaaaaatggcatgcgtttgcacaaaaaagaattaggaataaaggcaatgccagaatccttagtcgccttattttaccaaaatcaagtggttagtttatacatgccacacccaacgcatgataaattattgaaaccaagtaaagttctacggaacaattaaataaaaaagaaggaagtttttgcacatgcaagttattcaactacatcatccctatgaacccaatcaaattcctaatgaagaagtcgtgatggtcctaggcttttttgacggtgttcacaaaggccaccaaaaagtaattgaaacaggtaaaaagattgcggaggaaaaaggcttgaagttagctgtgatgaccttcg

SEQ ID NO: 38229 - DNA, 227 bp, Neisseria meningitidis
ccgaggggattggcctgatggaacggaaaaaacaggggcagggacatcccgcccggatatacgttaaaaattttatcttggaaccggaacccaccgcgccggttcagactgcggaaaatcagcagtcaagaccgcttcccagtgccgccgtcaagactgctgaaaaaccgcagtctgcaccacgggaaaccagcggtcaacagtgcggcatttccgcccctaataat

SEQ ID NO: 38230 - DNA, 503 bp, Neisseria meningitidis
ccggatctaatcctagttgtccagaaatgtacaacgtatttcccgctaagacagaatgtgaataaggtcctacagtagctggtgcctgtgcagaattaatcattttgtttgtcatcgttttcctccattctatgattctttattttcaattaaagtccctgtttttccagataatccttctttggctttttctaataacgtaatcaatgtttttcgacctggcttagattcagcaaacttaatcgctgcttcaacttttggtaacattgaacctggagcaaactgaccttcttgcgcatattgtttcattttttctgttgaaacattccctaaggcttcttgattttctttaccaaaattaatacaaactttttcaactgctgttaaaatcacgagcagatcagcatccacttgttcagccagtcgttcactacaaaaatctttgtcgatgactgcattgacaccttttagtcggttcccttcttgaatgactgggtatgcac

SEQ ID NO: 38231 - DNA, 492 bp, Neisseria meningitidis
ccgaagaactttttttgaacccacattgacaaattgctcaattgcctgcgtggcaccgccacggttatccaagagaacttgccgaatattcctatgctcagtggttcgatcaaggacaacgatcgaatggcctcgttcagcaaacttttcaatttcttttgttggaaatgtccaatctaaaataattgccccatccaccattttttcaggaatgataagatgtgactttttaccgctgcagacaatcatctcataatcaaacagtgctaagcctttcttaattccctccaacaattcaccataaaaactaccgccataatcagccaaatagacaccaataatattggtttgacgacgttttaatgtgcgagcgggcatgttaggaacatagtttagctcttcagcaattgcttggatgcgcgttcgtgtttcttcagttacctttgaactaccattcaatgcgtaagaaacggtcgagattgatacgcctgc

SEQ ID NO: 38232 - DNA, 523 bp, Neisseria meningitidis
cccttgatttttaagaatagatacagtagcataagaacaactagttctttcactggcaatcgtcaatgtcatatagaaaagaatgccctatctgtattatctgaaaaatcaaacaatcataaccaattagaaaggtggttattatgtataacttattaaccaaacaggaaattcagttactttccctaattgaatacttgtatgacagtaaagaaaaagtccccatgcaagtactccgacgaaaatatgaattttcccattacaatatcaacaatttattgaatcaattaactttgttaatttctcgagtcaatacacatgaaaatgtacatattcgtattattaataatcaacagtccatagaattagtcgcggatgaaaatatcccgattgagttaatgaaagaagctgttgtccgcgggtcactaacctatatgttagcccaggatttacttttaatacgctacacttcagccaaagatttttgtgaagagcctttattaacttttctattttttaacag

SEQ ID NO: 38233 - DNA, 482 bp, Neisseria meningitidis
ccaactagaagaagaaaatcaactatatcagcaatccattaaaaagctaacggagcaattattaatgcaaaccaatgaagtggaagcattacaaaaacaagtagtcgaaaaagatgttcaacttaaacatgttaaagaaacattaagtgataaagaaacaactatcacttctttacagaaacaattgtctgaagaaaagatgcaacagagacagaccagtgaagagaatttagacacagccgttacgctttctcaaaaagaaattggcgaagtgttattagaagccaaacgtcaagcaaaagatacaattagtcaagccaaccaacaagttgcaacagttcatgaagaaatggaacaacgtttagcaacttttacacgcatgaagcaagtggcaagatagtaccaagcttattgtgaacaaatgcagacaatcaagaatgaatcaacaggaacgtaccaacagatagagcagttattagcag

SEQ ID NO: 38234 - DNA, 523 bp, Neisseria meningitidis
ccggtgttattcatgtttgattattcgaaagaaccagtaaatgattattttctaatcgacatgaagtctttttatgcgagtgtcgaatgtatagaaagaaatttagatccattaacaacagaacttgttgttatgagtcgaggtgacaatactggttcaggattgatattagcttcttctcctgaagcaaaaaagcggtatggtattacaaatgtgagtagaccacgtgatttaccacaaccatttcctaaaacactacatgttgttccaccacgtatgaaactatatatcaagcgaaatatgcaggtaaataatattttcagaagatatgtggctgatgaagatctactgatttactcgatcgatgaatcaatcttaaaagtgacccgatcactgaatctttttacgactgaaggaacacgaagccaacgtagaaagaagctcgctcaaatgatccaagaacgtattaaagaagagctaggattgattgctgcagtaggtgtcggagataatcccttgttag

SEQ ID NO: 38235 - DNA, 469 bp, Neisseria meningitidis
ccggctccaacgtaccaactgtttttgaaatgattgatgatgccaaagtaattcctggtttaaccttaacagaaactgtctctttaaactatgcgatggaagaagaaatggctttaacacccgtcgactttttattgcgacggaccaaccacttattattatgcgtgatcgtttggaccaagtgaaagcgggagtcattgaagaaatggcacagcattatcagtggacagcggaagaaagagcacgacacattgaaacattagaaaaagtaattgaagaatcagatttaaaaaatttgaaagtagggtgaagaaaaaatgggaacttcgatgatgacacaattattcggtgaatttttcggaacgatgattttagttttactaggggatggcgtctgtaccgcagttaacttgaagaaaagcaaagcctttgcttctggttgggtcgttattgctttaggttggggcgc

SEQ ID NO: 38236 - DNA, 516 bp, Neisseria meningitidis
cccgtcttaaacggctctacactagagaggtatgttacagcatatctctcttttcaatgctattatagcacaacgaccatcaaaagaccatcaataaaaatgcccgagcctcttatttttctaaggctcgggcatttttattttaggggccagtcactaaattccacgtgacggcggcttggtattgttggccagccataccttggttggctggcacttctagtttgatgttagcaaacgtgaagtccaactgatagacgtcactgcctgtgaactgtttgtttgcgaccaccgctgttgcggtattgtcggcggttaaagtcacggtgctggtcttgccaagtggtgtcctggtttctgttggttggttgtaatcggtaaagctggcagcagcggccgttcctagcaacaagcgggtcgttgttggcaagctgtctgtggctgattttggttgcaatagctgggccgttaaactccaattggcttggctagtattcaggcgtaaattagggttgc

SEQ ID NO: 38237 - DNA, 513 bp, Neisseria meningitidis
ccagacacagaaattgaacgcaatatgattgaaacgagtcaacttgtcagccgtctaaaagagaagtaggggtgtgcaagcaaatgaacttagaaggattaacgacagaagccagaaatgaagcgactaaaaagattgaccaagtgtcaacattagaaatggtaactttaataaatcaagaagaccaaaaggtagcacaagcaattgaaaaggtgcttccgcagattgctgcagcaattgatgcagcggcagaacgatttaaaaaagggggccgtttaatctattgtggtgcaggaacgtctggacgtttaggtgctttggatgcgattgaattaacacccacatatagtgtgtcgccagaacgcgcatttagtattttagctggtggtgaaaaagcaatgtatcaagcaattgaaggcgctgaagactcgaaagaattagctatcgaagatttaacgcaacatcaattgactgcccgagatgtcgtaattgcgattgctgctagtggtcgga

SEQ ID NO: 38238 - DNA, 277 bp, Neisseria meningitidis
cggaaataatagggattctctctgctttattaatgtttatttttgctcctacattaagtaaaataagtccaatagttgatcatactgcgggtatcacagcaatccgtagcctttatttttttttattaattattcctatacttagcgcactaagagggtattttcaaggtctaaattatagtttttcttttggtgtttcccaactactagaacaattagttcgagtagtttgtattttagtaggaacctatctaattatagttcaatttaatggtag

SEQ ID NO: 38239 - DNA, 486 bp, Neisseria meningitidis
cccggtcaagtttacttagcaaaagttgtccgcattgaaaaatttggtgcgtttgttaacctaattaaaggcaaagatggcttgatccatatttctcaattagcaaacgaacgtgtgaacaacgttgaagatgtcgtgaaattaggcgacgaagtccttgtcaaagtaactgaaattgacaaacaaggccgtgtcaacgtgtcaagaaaagcgttattaaacgaagaaaacaaagaaaaataatttctttttaaaccaacgaaaaccaaggaagcttcctttcttttcgttggttttttcgttgaaaacaagccctaaaaaagaaatgataaaaaaagctaaagacgatcgccaactcttttgtttatagtcaattagtggtaaaattaatactatcagtctgaagaatatctggggtgtctttgtgaaaaaatttaatccaaataaaaatataatcattaccttaattttagtcattattttagt

SEQ ID NO: 38240 - DNA, 413 bp, Neisseria meningitidis
ccttgttaaagttaagaatacagcgttgacatcatccattaccccataaagtaaagcgaataatgagataaccacagattgtgttaacacaacgttacgagaaacgccatatttattttcgcgatggaaaccaaattttggtggcaataagccatcacgagcaacttgaataattgtttttgatggtccagtaacccaagcagataattgtaataacacacctaagaagaccatgaaactaaagatattaccaataattgttggtaaacctaaaacgtcacaataaagcaaaattggttgtgtaatgttagacaattccattttgccatttggaacaatattagctacatacattgcattaatcacgtttaataaaactcacccaattaatgacatgaaaacgccttttgtat

SEQ ID NO: 38241 - DNA, 493 bp, Neisseria meningitidis
cctggaaaattgtggtgcgatgactttttaaaacaatcgtactgcctaattttgcttgttggcgctggttatttgccagtgtttgttgctcgataggtaagtgactcaaacgttgccattccatttgatgaggtgtgaaaacaactttttcaggataggtaagggaaaaattgccttggctaaacagggtaattgctgagccatcgataattaaccattgttgtttttgatgttgggcgagtaccatctttaatatttgttgtgcagtagcatctaagcctaaacctggaccaattaaaataacatccgcttgctctacgacgttcgtcagaaggactgtttcttcaaagcccacgaccatcgcttctgggcatcttgcatgtaaaggcccgttatttttaacatcagtaatcacagtggtgagaccagcgccactattgatacacgcttcggtactcatgatgatggctccgcatattgtcggtttctccga

SEQ ID NO: 38242 - DNA, 400 bp, Neisseria meningitidis
ccaaaattttggtaaactaaaagatggaagtattggggtaaaaggtggttggcgaatttattcaagcgggccgggaatttatttaaatcaattaattacagctgttttagggattcggcaaaaggcccaaagtgtagtttttgatcccatgttaccagaaaaattgtctggtttaacactaacttaccaattgtttgataaacctgtcacatataaattttatccaaatcagtcagcgaaaatagttatcgatggtcaagaggttccgtttaagtttgaagaaaacccttatcgagaagggggaatggtagttcaaaaagacgaggtgctttcattattaattgaagcaagtgttattgatatttaccattagataggagagtagtccatggtaggaatt

SEQ ID NO: 38243 - DNA, 494 bp, Neisseria meningitidis
cccgttcgtttttatttcgattgctcatattagcaatttcggctcttgcccgcaagaacttgtcttccatttcggaaagctctgctttaagattttcaatctctgttgcttcaacttctacttcagaaacgccagcagcatcaacagcttccatttcttcttgtaattcttcttgcttctcttcttttttactcacttcagcaacttcctttctctttatgcatctacttcttatcctaacaaggtttgcttaattacctaaaaaacggtaatagtcacctagttgtgaagctagctcatgtcgaaacgtgtctaccaaaccgaatatttttgaatacggcatactggttggtcctagcagggcaattgttcctttgccatgtcctgatacttcatacgtagcagtgatcatgctcatatcttctaagagattgttgccaatttctgagccgatacgaaaaacaattggattttctgttgttgcagaaccattt

SEQ ID NO: 38244 - DNA, 527 bp, Neisseria meningitidis
cctgccccattcgtttaccgaccccaccggcaataattaaagctgtaatcatttgatacaaaatcctttctctaactagtcaaccactagttttatttcaattttgtttaacttatatattcatcaacacagccaaaactgcattcaatcttttacattttctcataactatcagtaagtttcaataatttatcgtagaccttaatcgaactgtaaatgagagtgtaaaatattttgtgtaaatgaaaaaatccatacaaaaaaggaagtcgcttctgtagaataaagttaacgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggcttttttagattacgaaaaatatgatcgcactggttctaattcaggtaattcgagaaacggttcttactatcgatcaatcaaaa

SEQ ID NO: 38245 - DNA, 519 bp, Neisseria meningitidis
  misc_feature (508)..(508): N is any nucleotide
ccgggaaaaaaattctattctacaaaataaaaacgttagaaaagccattagttatgcaatagacagaagtaattatgctaaaaacattttagataatggttctatttctgctgttggtgttgttgctaaagacgttgcttttgatcctagtacaaaaaaagattttgctaacaaaatgttggtgcattttgatacagaaaaagcgcaatcctattggaataaagcgaaaaaagaattaaatattaaagaacaagtaactttaaacattttaaccaatgaagaagaaacaaccaaaaaagcagctgaatacattcaaggacaattagaagaaaatctaaaaggtttaaaaattacgataacaccagttcctgcaaatgtacaaatagagcgagttatgaaacatgattttactattagtctaagtggctggcaggcagattatcctgaccctatgagttttttaggtaactttgaaagttacagtgtgttgaattttggagggtatagncatactaaata

SEQ ID NO: 38246 - DNA, 496 bp, Neisseria meningitidis
ccggtgaaatttcaccgaaataaacatattctgcttgatacatgatattgcctaattgaaaagcgtcatttactttgtccttgttttgtacataagtgttgtatggaattgctgtattccaataaaacttagctagcctgtgttgatcttgtttcgaataatttagcaaatggctagcaatttccgtattaaacacaaataatttatctttatttaaacggtctatctctatttctaaaatatatggatcgtcattcattagctgcagcaattcatagccaagacaactatcttcttcaaacataaaagtagcacatctaagatcgtagcctttccacccgtaagtatttagaatagaataggtttgctgattaaagagcgtatggtctgtacctgtctctcttcttaaaagatcctttgctttttttactcctactaaaccgtgttttctaatgctattgatattggacttatctgttaaatgaattaacttatt

SEQ ID NO: 38247 - DNA, 522 bp, Neisseria meningitidis
ccagcgctgcttcttcgggatcaggcgtcgttaaaccaaactctaaatgtgcgccgttagttcctaaaaaagctttgttaaaacgaaaatgttgtagctgttccatactagtggcaccaatgattgctttagtggagagcttcaaagtaccaccaagcataatagtgggaatttccatatcgctaagttttgcagcgtgatgcacggaattcgtcactacatggatttgtttcccaactaaaaaagggatcatttctaacgtggttgaaccagcatctaaatagatcatatcgccatcttgtacacaactaacggctaaagaagcaatcttttgcttttcgtgcgtgtttttgattgatttttccgtcatgttttgttcaaagcctaaattaagaatacgcttagcgccgccgtgaatgcgttctaacaaattggcgtcttctaattcttgtaaatcgcggcggattgtggattctgaagcattgaacaagctagcaagttcttgcgatttgacgactgatt

SEQ ID NO: 38248 - DNA, 486 bp, Neisseria meningitidis
cccgcacgttctaaaatttcagcaatttcctcattggttaaaagcggtgcttctttcagttcgtgcttatcaatcagctggaaatttctctccgcacgtggccgtagttgggcacgaacttttgaaaacttcacaacgtcgtctgtaatcgtccattctcctgtaccttcccaagcctgcactgctcgaggcgccacgtaattatcagcccagtataataattcttctttttcaatttcaaaggtcgaaatattgtctaaacgaggttgaataatcgtcattcgcacggtttcaaattcgtaaataatgtcgtacttatccaccgcaccaagcgcatataacatcagttgagggtttaaatacgcatcaacaggaacacctttgccgtatttcaagtcgataatttcaatcgtcttatctgataagacaaccacgtccgaagttccaaatccttctgggacccattttgaaaaatctactttttgt

SEQ ID NO: 38249 - DNA, 514 bp, Neisseria meningitidis
cccaaagtgatttaacgtttaattcagcgtgggcgtttaatccttcgaccaatggttatgcgttaggtttagcaatgatggacggtgagcgccgtgtaaacttgttaaattttgccaaagaacaaaagaaagattggcaggctgtcccagtacaactcgagtatatgtggaatcatgacggctcagacagtgccttgctgaaacgtatgtcgaaaagctctgatgtgaatcaattagctgtagatattttggtacattgggaacgtgcaggcactaaaaatgatcccaacgaacaaatcaaacgaaaaacaagtgcgaataattggtataagagactgtctacaggttctatgggggcaggttcagccaatattggtggtggcaaaattgatgtgttagaacaaatgttagggcaaacagtcaatggaggtcagtgttatggggggacttcttattatgttgaaaagatgggctttcaatctttaatgaatacagggcatatgtttgccagtga

SEQ ID NO: 38250 - DNA, 506 bp, Neisseria meningitidis
cctgcccgagaatgtggcggaggtattaaaattgcgccttagtttgtctaattcaagcacgaaaaaatatctgatgatggataatgcacgttgttcagataatcgcattcatggcattttacaattttacggtgccaaccgcacaggacggtgggcagggcgattattacaagtacagaacttgcctagaaactatttaagtgaaattgattttgcccgtcagcttgtgaaagcaaaagatgttgaaggcatcgaattaatgtatgaagatgtgccagacacattgaaacaacttatccgaacaggtttagttgccaaagaagggcatcggttcatcgtgtctgacttttcagccattgaggcccgagtgattgcttggtatgccaaacaagattgggtattagaagtattccgcacacacggcaaaatttacgaagcaacagcggcgcagatgttccatttaggcgaagtgacggactacgactggaaaagccacgaaggtaaat

SEQ ID NO: 38251 - DNA, 473 bp, Neisseria meningitidis
aagaaaatttatttatcgctagtacgatcaaagaacgggatcgaaaagtagttctagccgaagctttccaggtgttccaattagaacctgccttacttggtcgttcctttacttcttttacgacttttgaaaaaattacaatgcgcctaatacaacttttgctttcaaaaacaagtacgctcgtgattgatgacatcttttcttcattaacgattggacaacgtcaagaaattttacctcaattaccactagcagttcaaccaagaaacaagcgcttgctatttctgacaaaagatccacaaattcttgatagtccctatgtgcaccccctgtctctacatgcgttattaaactcaagaaaacgtctggcactgattgctaccagacgttttctttacgttctcagtaatttcaacatcaggaactgaaataataaacgtggcgactttaccaagttcactctcaacattaat

SEQ ID NO: 38252 - DNA, 479 bp, Neisseria meningitidis
ccgctcattaataagaacaggttcgggtagtagtatagaagatgctccaatgttcgcttgaaattctggtaagatatctgccagtgaataggataaagtatcttttgtgtcggtgaataccttattttcgctatctaaatgatacatggcgtgaataagttcatgagatatcgtgaaattttttcttttttcgcccatgttagaattataagctagcgtagtctcgtaatcatctttaataatcatacctgatatagatctacgtgctgttttttcaaatggaaagggccttattttaattgatttagatgttaatatttcatcccaaatatatctatgctcataattattaacactcattcccaaacataacatgtgtgctgaaataaattcgttaatggtaccgcaaaagttaaggtactcgtctacttctactgtcatcctgaaaaccaccttgtaattattcacttaaattttct

SEQ ID NO: 38253 - DNA, 539 bp, Neisseria meningitidis
ccggcttcttcaggccaaatcagccttctgcgcgaggggaagacgtttggagttggtttccagctgcggagaccaccagccaagcagcagtgcgactttcgcggttatgaacaaccggaaatggtcaagaaacggcctgtcgtcgtcatagcgcgaaacaggcacaacggcaaactggtaacggtcgtacccttaagcagcacagaacctgtccctttggcggactaccaccacaaaatgagtggaaaccccttaccggacaagccgcacatccaatgttgggcaaaatgcgacatgacggcaacagtcggattggcacgattagaccgatacaaacccaaagggtgcgaccgctgcattccaataatcagtgaagaggattttcaggcgattaaaacagccgttgccaaggcattcaaactgtactagaataaaaccgttcccttaaaggggcttgcaagactattctgaaatatgggcagccgcgcacgggcgacaggcgatgacaagccgtccgtgcgttttatggggcgcggaat

SEQ ID NO: 38254 - DNA, 335 bp, Neisseria meningitidis
tattggcttcatttaatgctcctgaaatccaagcgcgtgctgctcaaattgaagatttgaccaataaattccaaatcagcagcacaccgactgtgattgtcggcggcaaataccaagttgaatttaaagactggcagtccggtatgaccacgattgaccagttggtggataaagtacgcgaagagcagaaaaagccgcaataagttgaggattgaatgagtaaaggccatctgaaaataggatttcagacggccttttgtatttaggctttatagaagagatgattgcttaaagccttatggttttaaatcagaatatatagcggattaacaaaa

SEQ ID NO: 38255 - DNA, 384 bp, Neisseria meningitidis
ccgaagatgatgctggctttgcttcttctatggcccggtggtgtttttacaggaggacggctttgggtaattcgccttgtacgagcaagagcggcaggtagtctccgggcaggcgcagggcgacatcctgcatttatttgcgcgaggaaaacaagacgagcgtgccgatggcttcggtgggcgaaataagcttgggcagccattcgatgacggcggcggtgtgggcttcggggtctttagggctggcgtatataggggggatgtagagttcgccctgtttttcaaagtcaaaggggcttttaaaggcgaaggtagtggtttcaggcagccattacaacccggtttagcgcacatacaagttgaagttacccaaagattacaggg

SEQ ID NO: 38256 - DNA, 191 bp, Neisseria meningitidis
tactaactctgctgtcgttcttgcagttacacctgcgacaaacagttcaatgagtttatttgtttataccggcttagacgactttttctcataagggcaactctaacttaatttggatttccctacttatctatgagagccccttgtttttaattgactataatccgctatattgtgagaagctggatgac

SEQ ID NO: 38257 - DNA, 405 bp, Neisseria meningitidis
  misc_feature (379)..(379): N is any nucleotide
cagctcggtaataattacgaattcgagctcggtaccagattccctgtcggagatggaggagtttgaccgcctgattctgctgatacgcaaactgtatcaaatattggacgggcaacatatcctctccagagtaacggtttgccttcaccaccaaaaccggcgcgacctgattgccttggataaagcggctgccggttgcgattcggcaatgttgcgcgcccaacgttggctcatctacacgcaaattgcggaacgccttgccgggtcgggcggcggtttcacggttacggtagaaagcgtgtccgccgcctgtccggagcttgaaggacgctatctcgagcttgtccgccgcgccgccgtctctttcggtttcacgcanagatgggaaaatccggcaagcgggca

SEQ ID NO: 38258 - DNA, 903 bp, Neisseria meningitidis
cctttcattcgctgctggcggtttctatgggttcggtattcatgggcgcactgacctacatcggcaacgcaccgaacttcatggtcaaggccattgccgaacagcgcggcgtaccgatgccgactttcttcggctatatgatgtggtcggtcgccttcctgacacccgtcttcatcgtacatacccttatctttttcgttttcaaactgctgtaaacgctatgccgtctgaacattcagacggcattttaaattccggcataatcaaatcaatatccccccttccgacaatttatagtggattaacaaaaatcaggacaaggcgaccaagccgcagacagtacaaatagtacggaaccgattcacttggtgcttcagcaccttagagaatcgttctctttgagctaaggcgaggcaacgccgtactggtttttgttaatccactataaaatctaaagaaaccttttttcccgataagtttccgtgccgacaggtctagattcccgcctgcgcgggaatgacgaaatttcaaagttatggcgttatcggaaaaacaaaaaatcaaagccggagaatttatcccaaacaaccggatttcaaaaaaccagatgcccggcgggaatgacggatcttaggcttctgtttttgtttctatagtggattaacaaaaatcaggacaaggcgacgaagccgcagacagtacaaatagtacggaaccgattcacttggtgcttcagcaccttagagaatcgttctctttgagctaatgcgaggcaacgccgtactggtttttgttaatccactatattttttcaggaatgacggtttggaaattgcccgaaaccccaaaaacagaaaccagacaaacaggttttccgccaaagccggcattttccgactttgc

SEQ ID NO: 38259 - DNA, 382 bp, Neisseria meningitidis
ccgggtggatggtatgcgcacggatgtttctgaaataatcgcttaccgtgcttgtgttgtttgcaccggttgcttgcggataatcgtgggtaatgcgttcggcggcataagctaaatccgcctgcacataatacgggctgcggctgccgtcttcacttgccgcctgcgctgcggaagataagacaacagacgagaatagaagagaagagaagagaagagaagacaagagaagagaacagaacagaatagaacagaaggttttttgggggctggattcattttcgactccgtattcggttttaactgattaaaaagaacacttttcaatgatcttgcaggagcggactataccaggtttgtggcgatgtttcaacacaatata

SEQ ID NO: 38260 - DNA, 1034 bp, Neisseria meningitidis
caggaaggacgcggcatcgggctgattaacaaaatccgcgcgtatcatctgcaagaccaaggtatggatacggttgaagccaatttggcactcgggctgcccgtcgatgcccgcgatttccgtttggcggggttggtgaatctgattgcgtgcggaagcacccgtttccgattcggtgcggagcaaatggcggcactttatgtaccgttctgcgtgttgaaacatataggcagataaaaaagccgcccgttgaaaagcagacgacttatgttttgtggcactaatttgtcccgataagcattaactatataatttatttatcattattggtgcggacggagagactcgaactctcacacctctcggcgccagaacctaaatctggtgcgtctaccaatttcgccacgtccgcatgggaattggacgattatacagattttgtttttttgtgcaaggttttcggcggggctgttgatggcttggggtttggggcggtaaaatctgtttttcgtccgcctgacatcggaatcgggcggttttttgtttttattgacggaatttgggtatgcctgctgctttgattaaggattttctgctgactcagggtttgaagctgccgcttgacgaggttcgggcggcgtatctgacggcgcagacggtaatggatatggggacggcttcgatagaccgttcggttttgtggcgcagtgatgagggttggaaacttgccgattacctgtcgtgccacaatgtccgcgaagatgcactgaaacggcttttcatggctttggattcggtgttttcgcgctcgacaggcgtgcggagtgcggcggtctatgccttgatgccatctgaaaaccaggctttccaactgatatgcctgtcccgacagggcgaggttttggaaaacctgtgggatttggatgaagcggcaggcaaggtttcgctggcttgccgttcggcgcaaagcggttggatgaatgttgcctcggatgtacgccgttggctggatttgggggagctttcgggagaac

SEQ ID NO: 38261 - DNA, 272 bp, Neisseria meningitidis
atcaacagcgcgccgtatttttcggtcaatccgcgcaaggctttgacaaaggcttcggtcgggcggacgaggttcatattgccgacgaagggttcgacaatcacgcaggcgatttcattgccgttttgagcaaaggcttcttcgagttgggcgatattgttgtactcgattaccaaagtgtgtttggtaaagtcggcaggcacaccggtggaagacgggttgccaaacgtcagcagaccgcttgccggctttcaccagtatgctgtcggaat

SEQ ID NO: 38262 - DNA, 550 bp, Neisseria meningitidis
ccaacatacaggccgctgtagaaacatggcggcaaatcggatatttcagtctccactataaagaagcagggggcggactgtcaatactcaacgcctgaaaacaaccgtaaaacagcctgtttcctgatagtctatcatgccgaaaaatcaattccgtgtcattactttagggggattttttccatatcgcacgattgccgttgcacaaaaacaacaaacacaacggcaaagccccataccgtaccggcaagaaaatatgataaattataaacaatgttcagccacccgacacagacccacaccgacccgccatgaaattacaacaattgaaatacgccttagaagtttaccagcacaacctgaacgtttccgaagcggccgaagccttgtttacttcgcaacccggcatctccaaacaaatcaaattgctggaagaagaaatcggcattcagatttttatccgcagcggcaagcgcgtggtttcggtctcgcagccgggcaaggtggttttggatattgcgggacgtattttgcgcgatgttcaaaacat

SEQ ID NO: 38263 - DNA, 662 bp, Neisseria meningitidis
cttgccgattaagtgggtataacgttcgtgttcaggattgacggcaacggcaacgtcgcccagcagcgtttcaggacgggtggtcgccacgataacggcttcggcgggattgtccgccagcggatagcggatgtgccacatagagctgtgttctccccacgtcwgacgaccttttccgtttcaaccaatccctgcgcttgattattggtaataattcctatttaattcatttgttagacaactcgttcctatccaatcatgaacaccgccgccatctaccgccagtaccaaacctatgtccgctccgataaatccggctgggcgttggacggctgttccgacagcgcgctcattgcgcaggcaaaacagcccggtttgcatctggaaatgtgcatcaaccgcttcgattcgggcatcaccttgtcgcggatgcgcggcggcggaacgggcgcgtttcccaccgaaatccacaatttcagccacaactgcgccttgttcgtcatggtgtcggggcagaaccggttacaaatgggcggcagggaataccgcccatctgccggcgaaatctgactggtacgcggcgatttggcggacgtatccgaaaccctgctgcccgacaacagcggcatgtgcgcgctgcatttggattttgtcgctggaaa

SEQ ID NO: 38264 - DNA, 350 bp, Neisseria meningitidis
ccgccattaacactgggtaagttaacaaaccagttgggatagcaatggtgttattactatttcttttttgcgctaatttctttgttttaaattgggtcattctttgtaattcacctagattactttgtgtcagcattagataacctaacatggtatgttccatcagatcactttgtaaaaataagttcacttttccataatcaagtcctagtgctaataaagttttaacaagttgcaagttgttatctttgagcattgttggttcaaaatcaacagtaatagcatgaagatcagcaacaaataaaaacagttggtattgactttggagttgttttaaaccttgcattacg

SEQ ID NO: 38265 - DNA, 270 bp, Neisseria meningitidis
cccgcgttaaaacttcctttaaagtttcaatttgttgtgaaccccccttaagcttaaattcacttgcaaggttaacctttttaagatcaactaaattaatttggtttaaattcaagtttttattagaaactttaaagttttctttatgagttactactatttgtttatctttggttaattgaatatcaattcaaataccatcaaaatcaaaaacttgggctgcttgaaatgctaatttggtgttttctggtgcaatagaactataaccgc

SEQ ID NO: 38266 - DNA, 691 bp, Neisseria meningitidis
cagtgagtttttttgacaagaaactcatgggctttttgtggatcagagccaatctgaacaagctgctattagcttttgaaatttatatcaggatttaattattaacaaactttgtatccctgcttttgttggtttgaaaagtgaaagtgaaaaatttgcaggtgctaaaaacacatggacaatagaagcaattatgcctgatggacaaagtttacaatgtgccgggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaaaacggttatccacagaatcaggggataacgcaggaaagaacatgtgagcaaaaggccagcgaaaggccaggaaccgtaaaaaggccgcgttgctggcgtttttccataggctccgccccctgacgagcatcacaaaaa

SEQ ID NO: 38267 - DNA, 282 bp, Neisseria meningitidis
ggtatttggtccattaaggtgagaagttattacgtattattaacaaaaagggtgatgtttaaatcaaattcatctttttgtttgttgatcttgggaattattttttcaatataaccatcaccattaataattgtttgacagattttattaatggttttttcactccacactccgttaatgttaatgtaactgcgaaacttacgtggttttagttttaactgctggatatttcaatataacgggataatttttaactgctttttattttgtaaattcttacaa

SEQ ID NO: 38268 - DNA, 620 bp, Neisseria meningitidis
ccagaaacttagtttttggaaccagatcatataacgatggtcattaggtggttgttattgcaaccgaaacagatagttcccaaattaattttctaaacggttctactaatcaaggtacaagttctcttagttgaggaggtaccttgggtaccaccatcagacaggtgcaaaaccgttattctacttatccaaacggagttaaatttttaatttggaatgatattgctcctggttcagtaaagtgaaacccatatgcacgttttcctgttgtggatagaaaaaacgaacttgcaagtcagggtaccgagctcgaattcgtaatcatggtcatagctgtttcctgcgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaagcggtttgcgtattgggcgctcttccgcttcctcgctcactgactcgctgcgctcgttcgttcggctgcggcgagcggtatcagctcactcaaa

SEQ ID NO: 38269 - DNA, 352 bp, Neisseria meningitidis
ttaaatcggaaatcatctaaagtatagacaaaaaagcgatagtcatcaaacttattaactgctaaattaagtaaatcagttagtgaatttttcagtttttctaaagcttgatttgtttgactcatcaagtaaaacagtttttcataattgatttgattctgagctaaactttgatggtttaagttattaatatttttagtaattagatcgcagttctcattaagctcaataattaaatcatgcacatctgtttcattttggaacactaattcaatggctttaattgttgtttttaaaagctcatttttcttttcatattgttgaatttgattacgaaaatcatcaatatttt

SEQ ID NO: 38270 - DNA, 366 bp, Neisseria meningitidis
ccaaatttaatgtactaattctgttagatagataagaattggctactaactccacctcctactaacaacattttaggggcaaattttttaattgcatttttaacatgatcaatgtaatgatcaataatagtagcttgaaaattggatgctaattcactccaatcaattcgggttttattagcacttatttgtttaatcttgtttaaacactgagattttaaaccagaataggaaaacttagttcacttagtagaaggtttaaagaaatagtgaggtttaactaattctttattaaaaagactatcaattttactaccagcaggataatcaaagcccattgctctgcctatcttgtcataaacttca

SEQ ID NO: 38271 - DNA, 378 bp, Neisseria meningitidis
agataagaaatacaaaattctcattgaacaagagttaagtaatcccaattttcttagttatgaaaatgacgaattaaaagcacaatgtcaaaccaaagaattaactgaatgattagttcaaaaaagtaaatctttcattttttggatgaataatgctggttttaaaaactttaacttcattgcactttatcctattgataaaaatgaatctaaattaaaagtaaaagctgtaactgtttctcaatatgataagcagtttgaaacaaaggtatttgcaacagaatttatccctatccacaagattaaccaacagatcgatgatgtcaagattattgggcaaatctttgaattaaaaacccatgaaagtttaactggtaa

SEQ ID NO: 38272 - DNA, 634 bp, Neisseria meningitidis
cccaggattggcaatttttatgcctggttgcatcttactttcctcgggttcttttagaagttatatcccaactcctagtttaagaaatactgttggtaatcacaacagttatgttaataatactgtccctaaaaacaatttttatgaaaagttttatgatctaacttttgctttaaatttcactaatcagaaaactcaagagtttggtactggttggttaattgactgaaaaggagatgaaactaaagatcttaatacattaactatgggtaccgagctcgaattcgtaatcatggtcatagctgtttcctgcgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgaacggtatcagctcactcaaaggcggtaatacggttatccacagaatcaggggataacgcaggaaa

SEQ ID NO: 38273 - DNA, 337 bp, Neisseria meningitidis
atccttatagctatttcgacgagatccagctatcacggtccactaattggaatttcacccctaatcacaagtcatccgctatcgtttcaacgagagtcggttcggtcctccagttaatgttactcaaccttcaacctgctcatgactagctcaacccgtttcgggtctatgataacaaacaaacgctctcttaaaactcgctttcgctacagctccccatctcctggttaactaacgcttgctatcataactcgccggctcatacttcaaaacgcacgccatcacacattaatgtgctctgacacgttgtaggcatatggtttcagaatctatttca

SEQ ID NO: 38274 - DNA, 312 bp, Neisseria meningitidis
ccgtgagttgttcacgttgttttaaaagtgattcattagctttactgaaagcagtttgctcaaggtttaactggtgttgttcacgttccagttctagctgagcttgtactgtgtcttgcttttggttttgcagcgcttgaaacctgttatcaagttctagtttgacctgattatttttttcagctaacttgtcaagttcacgttgcttagcttcaatttgtctaaattcttggtccttttggagttcaaaaacctgatagtctttttgtagatcactaaaagcaatctttagttctgtttccttttgggttt

SEQ ID NO: 38275 - DNA, 256 bp, Neisseria meningitidis
tttgcaaaacaacctgaatcaacaactgatagctacagctttgacagtgatttacctcaaccaacccttgaccaaccttctttagatgatcatgttcagtacaactttgatcaccatgaagagctcaaaccagttgctgaagaacaaaataattatcaagttggatttgatcaagttcaagctaatcttgataataatgaggaaatacaaccaactgctgaaaaaaaagtaactactgattttgaaagtaaacaag

SEQ ID NO: 38276 - DNA, 283 bp, Neisseria meningitidis
cctgacaaactaaatcaaagtgaaagatatttttcgcttagcttcagggcaaattttttaaaagttaattttgataaatgtgtttttgcaagtacaaaaacacatcataatcttgctttagttcacaaaaaaattttcgaattattcgttgaagatgaaagataaatttagttttcaaaaaaactatgatttcaacttagttagtgatgggctttatgaaatttgaaataatgctggtttttttaaacctaaagataaaaacaattcttttacagcaattctt

SEQ ID NO: 38277 - DNA, 226 bp, Neisseria meningitidis
cagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcacccggactcggtaatggcgc

SEQ ID NO: 38278 - DNA, 271 bp, Neisseria meningitidis
acctgtttcaagtgaaagttggtagttgtgttcaactgaactaattgcatttcttctaacctgagcatcaacttgtctttttctttggcgggttttggcttgctcacggttttgttcaaaggtgagagtaacagaaggtaatcccccattaaccaatcaggacttgtcaatgttgtcaagttcactagcagttttatcattagtgtttttagtaatgtttacagaagaaaagccctgaatgaataaactgttagcataacttttttcaaca

SEQ ID NO: 38279 - DNA, 721 bp, Neisseria meningitidis
ccagccactaggtaagttaaccaatagtggtacatactgggcacggggcaaacatcgtgttaggatcaaatagttcagttactggtaaggtgaataacctattaaagtcaatctggttaccaggtttaaagctaattttttcagtatcactatcactagttgctccctggccattgataaggttaacaaggggagtagatactacgccagttagtttaccatccatcttggtaaatgtactatcacctatccctatttcactcttattgttttgtttactatcaaagaactttttaaggggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgc

SEQ ID NO: 38280 - DNA, 329 bp, Neisseria meningitidis
ccgatctgaaggcttggggattttgtagtggagttgaaaactatgcgagacacttagagttgaggatggctaactcaaccccttacagtatctttgattattttaagggggattggttactggttattgatgaatcacaccaaactttaccgcaacttaatgggatgtataacactgatctttcaagaaagcaaagcttaattgattatggttttcgactcccatctgcacttgataacagaccgctctcatttgctgaattacaacaaaaaatgcaaaaagttatttatgtttcagcaactccaagagataaagagattagtttaagt

SEQ ID NO: 38281 - DNA, 279 bp, Neisseria meningitidis
gcgaagatgatcttaagggcttagattccaatcaaactcaagcaggaaatgttccagaagttgagaccgtttttgtttacgaagatgatcttaaaggcttagattctattattaaagacgaccaacaacatgatgaaattgctaaacatgttgaacatttaagtcaagattattctaaagagataaaagatagtgctaaagcagatttatctaatatttctgatgatattgattcagtttgaaaagaattcggttcttttactgatgagacacaaaaaa

SEQ ID NO: 38282 - DNA, 588 bp, Neisseria meningitidis
gactctagaggatccccgttattagtcactatccccttatgaaaagactatttggaggttaaaattctaagtaccatggagttgaaaacccctaactttaagctaattgatgaaaagattgctgaatttaataagagtaatgaaaacctgattgtaaaactacttcaaaaagaaaaggaatttgccacaaaccaagttactgttcagtttgatactcagtcaaaaaagtcagaagaagtgaaaaaacctagtaaaaaaatactgaaaagttatcactgggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgaacggtatca

SEQ ID NO: 38283 - DNA, 334 bp, Neisseria meningitidis
aagtttatttctttttcttttgcctctattatatttctgtgaatgatgtggttttattttgttattggaaataataacgttattcatttttttcaaaattttattcaattcacttttattaattaatattttcatttttgattaagtattaatttctgggttatcaagggttatgatatttatttctatttttttattttctttaatatctattatttattataagaactaaaatgtctataattttgttcataaaaagcttataattaagcataaatgcttaattatagtaataattaatactctctaaaatagatactattatatataacag

SEQ ID NO: 38284 - DNA, 320 bp, Neisseria meningitidis
cctgcaactaatttaattgcttggagactgaatgcaatccaaagtggcaatattaaaccttcaactacttttaagttggaatttgttaattttaaacaccaacagaagtttgtattaaattggtttaaaaatgaaagtgaatcactgcgtgatttccaatcacagtttgagagaatcaataagttagtggaaagggagtttgttaagtaacaatgttaagtttagcacaattagaaagttggttttttatcgctccagcactgcttttagcagtattgagtggttatctcgctgaacgcgttgggatcattaatattgct

SEQ ID NO: 38285 - DNA, 312 bp, Neisseria meningitidis
tttactgtggtttggattaacttatcctcattgaatttcactggtagtgctgcagttctgtgatcctgtcaaacgatggcattataaacaggcaaaccattttctttatttcataaaactattgtttctctttgattggtaataccaactgcaatcacttcatgagatttgatttgtgctttatttttagcactttgcatggtagctagttgggctgatcaaatttctagtggatcttgttcaactcaaccactattaggaaaaaaagtgttaaattcgttttgtgctattgctatttggttaagattgtga

SEQ ID NO: 38286 - DNA, 524 bp, Neisseria meningitidis
gttgatggcgagataacgtttgtcgtaatctggacacgtaaaatctaaagaaccgttttcgagggcgatgtagcggttgtcggcggcaaccaaaatattgccggggtgcatatccgcgtggaaaaagccgtcgcggaagacttgcgtgaagaagatttccacgccgtaatcggcgagtttgtgcaaatcgatgccgtctgctttgagtttggcgatgtcggaaaccggcgtgccgtccatccattcgatggtcagcacgtcgctggtgcagtagtcgtaaaacaccttcggcacaatcagcatatcgctgttttggaaattgcgtccgagctggcttggcattgccggctcgcgcatcaagtccaactcgtcgtgcagatatttgtcgaactccgcaaccacttcgcgcggcttcagacgcttgccgtcggcaaacagacgctcgacccagcctgcaccaaagcgcatcagcgacaaatcctgttcgatcacgggcaaaaggttggggcgcaaaactttaaccg

SEQ ID NO: 38287 - DNA, 705 bp, Neisseria meningitidis
tagaggatcccctgatccactgttaattgatcaaatgcatttaagccaataagctaaggggcaataactttattaacgttatcaacggcttcgttaacgcctttaccaaaataattttttggatcattatcacgtaattcaattgcttctttctcacctgtagaagcacctgatggaaccatcgcttcacctacatgaccagatgccaatttaacaacacaagctactgttggaacaccccgagaatcaaaaacttgataagcaaaaatatcggttatttttgaattgatgtttagatttgaacttcccgggtaccgagctcgaattcgtaatcatggtcatagctgtttcctgcgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaagcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaaggcagcaaaaag

SEQ ID NO: 38288 - DNA, 719 bp, Neisseria meningitidis
cccgttaaaagcctttgattattccaaagccttttgaataaggcgtggcttcacgtaaattaggtcaaaattttacggttaatttaagcgtcattaaaagaatttttgcttttgttaaaaatttaaatccacaagcaattgttgaaataggtgttggtaaaggagcgttaacaaattatttgttaaaactcaaaataccttacaaggggatagaaattgataaacgcttaattgaatatcttctagttgaaaagatattaactgaagaccaactagttaaaggcgatattctcaaaaaggactttaatagtttttttgaaaatttaagtccattgggtaccgagctcgaattcgtaatcatggtcatagctgtttcctgcgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaagcggtttgcgtattgggcgctcttccgcttcctcgctcactgactcgctgcgctcggtcgttcggctgcggcgagcggtatcagctcactcaaaggcggtaatacggttatccacagaatcaggggataacgcaagaaagaacatgtgagcaaaagg

SEQ ID NO: 38289 - DNA, 208 bp, Neisseria meningitidis
tggcttttgcaatgcaaacatccaaaaccacacataaccctttgttaaccaatcaatagtatcagataaaaatccaaaaataaaaccccaaataggaccaaagatccatccgaacaatgcaaagggaatccttagaaaactaatgcttaatacattagtaacactaattgaaaagatagaaaagataaaggttagtgctaataaaaca

SEQ ID NO: 38290 - DNA, 295 bp, Neisseria meningitidis
ctagaggagtcccaagtttgaatcgtcatttaacaagaaatgaacttgagaaagcttaaataaaattcgctctttgattaaacaaaaaataagctcaaaagagatttttactgattttgaagggagtcaaaaactaaatgcaattgcttattttgaagaggaatattctcaacatgaaatattaagagtgatccgctttggtgattatagtgttgagttgtgtggtggcactcatgtagctaacactgcttcaattgaagattgttttattactgatttctattctttaggagct

SEQ ID NO: 38291 - DNA, 310 bp, Neisseria meningitidis
ggagcatttaaaaaccaataaacaccaactccagcagcactaaatgcagtaatagcagcaaacacaaagtaaaaaattaattgcatctttttagttttgttgagttgttcaatacttttttgagaatgggctttcgcattctcattacgcttacttgcccacacttgaggaagtttttgagagagaaattggactggtaaaacaatcactaaaaagatgcatgacaggtcacccagttgtagtgaaattagagacaatttctgttaaaggtacttttgaaagatcccaaaagttcaataagatgattgct

SEQ ID NO: 38292 - DNA, 388 bp, Neisseria meningitidis
cccaaagttactcaagaaactcgcttagaaaatattaagggatggaaaaaaataatagagcaaatttatcaagaactgagggttgtaagaagagatgcattacaaatgattaaaaaagataatcacaatgaggatttagaaaactctttaaaagctgaaatagaaaaaattaacaaaaattattctaatcaattagaagagattcaaaaagacaaagaagaagaattgctaacaatttaaatgaatgaaaaagcaaaacaattcatcaaaaagcgaacttcagtattcattgctttattagttgtattttgcttttttcttttaattagcgcatttgctgatggttttaacttttgatcaccgtgatcagcagatttcaattcaagaa

SEQ ID NO: 38293 - DNA, 382 bp, Neisseria meningitidis
tttggaattcaacttaactgatgatcacatcaaaattgttcagagacccagatgacgctaagttaagtgatgccacctttgttatttttgatattgaaaccactggattacatggtaggtatgatgatgttattgagttttcagcacgcaaaattaagaataacagcgagatagatcatcagcaattctttttaaaaattgacaaacctatcccaaaaacaatcactgaaatcaccaaaataactgatgagatgcttgaaggcggtattgatcaacagcaaggtttagaaaagataagaaattatctagatgattgtgttatggtagctcataatggtattaattttgatttaccctttttgcaaactcaatttgaaaaata

SEQ ID NO: 38294 - DNA, 277 bp, Neisseria meningitidis
cggtcattttactacggtgtaaaaaacgtttcattgcacagtcgagagatttcaataattttaaaatttatatttttattattaccacatgcgacttgaaatagaaaacgggcttgaatttgtcaatgatcctgtggtaaatgaacttggcaagatctgtttttttcatccttttacaggtaatttaacaaacaaacttagtttcagaagtcatttcaatagatacagtttttatgccattaactacccagggcatggtaatagtgttattaacaat

SEQ ID NO: 38295 - DNA, 354 bp, Neisseria meningitidis
caaaaatacactaaaaaaaccagttattatccatgttggaactctattggaacttgggaaaggtttattgctgctttacttgaaaaaacaagtggtaattttcctttatggttagcacctgttcaagccgtaattattcctgttaatatccaaaagcatttaaaggcagcaaaaaaactttataacaaattgctaaaagaaaacatccgtgtaaatttagatgataatcaagatcgcttagctaaaaaagttagacaagcaatcattgaaaaaattcctttacaacttattgttggagataaagaaatagagaatttagagaagttgacatgccgtggttttaaaggtgaaaaa

SEQ ID NO: 38296 - DNA, 309 bp, Neisseria meningitidis
ggccctgctggttatattgctgcggagtatgctggcaaacataaacttaaaaccctagtgattgaaaagcaatactttggtggggtgtgtttaaatgttgggtgtatcccaactaaaacgttgttaaaaagagcaaagattattgattatttagttcatgccaaagattatggtatcactattaatggtcaagctaaacttgattgaaaacaactgttaaaacaaaaacaggaagtagttgataaattagttgcaggggtaaaaacaattattaagggtgctaaggtagaaagtattgaaggggaagct

SEQ ID NO: 38297 - DNA, 252 bp, Neisseria meningitidis
  misc_feature (50)..(50): N is any nucleotide
ccaaaaatggttttgaccattcttggtaaatttctaatagtcgggagttntcccgtggtgtttggtgacatttgcaataggttgtataaataatctaaatttggataaaaattactttgattattggttgaaatattaaagctttttaacgcttcatttttatcaattgattcatcaattctttgattaattaaactaacttctttaattgcatttatgaatttatctttaaatttaatagttggtttaatt

SEQ ID NO: 38298 - DNA, 211 bp, Neisseria meningitidis
ggtcaaaaagcagctttagaacgatttagcaattagtagtggaaccttagcatataataacgaaattaatagtggttttaaagatgttactgttgataatttaggtgatgctagaaaggttcaaatagctaaagaaaaaactactgttattggtggtaaaggcaataaggataaaatcaaaaagcatgttgaacttctaaacggaagatta

SEQ ID NO: 38299 - DNA, 235 bp, Neisseria meningitidis
ttggtcccatcaattggttggtaaatttgggaggatgtacaagagtttctatatgcattgccggtagtgagtttaaatccagttgaagcattggggctgggattgttgtttaagccaatggagttgcgcatcgatcgtcactgatttgaatttgaaccaagatgtacctctatctggcttttgcccttttgtttggccaaactactgtttaaggtatatttagtcaaaggttgtt

SEQ ID NO: 38300 - DNA, 165 bp, Neisseria meningitidis
cccgccttcagcgccaaaaccattacaactatgacatgaaacttttctttcatatttgatggttttgttgcaaccattagtcatttcaaaaaagttaatttcaattactaaagcaatatcaaggttatagggaacaacaatttgttgttgacgttttttagaacg

SEQ ID NO: 38301 - DNA, 338 bp, Neisseria meningitidis
ctactgttttttcatttgaagcggattcaactggcagagcactagtaaatactctagtaattattttgattactatcaccattacttttccactagcacttttaattgcaatttgacttaacgagtacaataattcaaaagtggttaaaaatgtttttaactttgtaattgattcactaagttcaatgccatctattatttatggattatttggactttctttctttttaagagtcttgcagttaagtgctggaggagctaatggtactagtttaatagcaggcattctaactattagtgttgttatattactcttccgggtaccgagctcgaattcg

SEQ ID NO: 38302 - DNA, 326 bp, Neisseria meningitidis
cccccaaagataaaacccctcgcttcaggacatactatcgcttctgcattaatagctttaataaactgtgccatttgggttagcacaaaattaaatagttggggattggaaaatactggggtaatgtcataaaacaatgtaccttggttgggaaaattttcaaagcgcttgattgcttgatcaagcaacttaaagttttgatccataaatatcttttttttaaaaactgttaattcctgcaattaactgctcttcaatctgatcaatctctttaaaaggatgttttttgtgttttaagctcaaacgggaatgaacatagttgaaag

SEQ ID NO: 38303 - DNA, 347 bp, Neisseria meningitidis
gacatcttcttttctatccagggatagttacttttaagcatggtgaagcacggcatgaagctttaaagattattcctagtgaattacttttaagtgaactgactcaccgtgattaaccccttctccttttcgaggcaaagttaactgacctgaatatgtagttcatactgttagcactgttgctgaaataaaaaaaatagaaattgctgaaatgaagcgaattattgttaaaaatgcaaaaaaattattttgacattaaaagttaaataaagcaatttatttaacaaatggatgttagaactgaaagattaaacgaattgttttttgtttatcataaaaacttaaaa

SEQ ID NO: 38304 - DNA, 277 bp, Neisseria meningitidis
aaattaccttgcgttgacaaacaagatattaaaccagaagaagcagacgaacttaaaaagcgttttgttgaagttggtgcaactgttgaagttaaataaagatggcagtacaacaacggcgttctagtaaacaccgtcgtgataaaagacgttctcacgatgcacttactctacaaactttaagtgtttgtaagaaatgtggaaagaagaagttatcacatcgtgtgtgctcttgtggtatgtacggtgaactaagagttaaaaaagctcactaatt

SEQ ID NO: 38305 - DNA, 223 bp, Neisseria meningitidis
agttagttgtaaattcgcttcaaaaacaccaaaagctcaccaaagaaatagaccttgatttcaccaagcttgatgagattattgcaaccatttttgatgaaactaagaatccaaagactggctttactaacttcattaagcagtttgaaaaaaccaaagcaaaactaacaaaaaagatagctgaaattactaaacttgatcattcaacgccaacaaattatca

SEQ ID NO: 38306 - DNA, 256 bp, Neisseria meningitidis
actagtttcatggtaatcaaagttaataggatcaattcctgcataagcagttttaggtaaagtactggtttggataaacaccattgcatcttgttttaaacgagtttgaacttggtagttcatctcttctggtttggaatttatcttaggattggcaaacctacccaataagaatgattgggttttttgatcaaatggaaaactaagaccatttccatctttattgtatggttgataatcatgatcattctttaaa

SEQ ID NO: 38307 - DNA, 335 bp, Neisseria meningitidis
caagaaaaatagatcagtaggatcaatccttttttatgtacctagttttattctgattattgctattctaattggttcttttgttgctggtagtttattgttgcaagatgtcaataattatcgtgattctgcttgggaagttagtttatttttctcacctaatttaattgcaacttttttttcaattttgttaacaggaacagtagttagttatcttttccctcgttataattttgctgaaattaaagtatttactgataagcttgaagaagttagaaaagcattgttaagtgataatgctaatcacagtttatctattcaagaaacgcttggtg

SEQ ID NO: 38308 - DNA, 298 bp, Neisseria meningitidis
ctggttattcttggcctttttagcgcggttaaaatggtgcacttatttttggagttttttaaagctttgtttcacaattttaagccaacgctttacttcgttatgtgcttcttgtcagggttggggtgaagtaaggtcaatccctaagagtttaatggtttcaagtggcgctaaactagaacctgaactgaggaatttaaagtaattatctttcatctttttatcaccactattaatttttttagctactaaaatacctgcaacttggccaatggcatacttgtaaacatagaagtta

SEQ ID NO: 38309 - DNA, 222 bp, Neisseria meningitidis
atgtaaacagtgttaatttaacaaataatgaaaatgaaattaaagttaaacaaactaaaaaaacaatgtgtgaaagatgctgaaattttcaaacaatcattaagccaaaattagatcataatttgtgctcacgttgttttaaagtgtgttaaaaaaataattgtgaaaaggttttcagatcttaatcagattgatatttctcaagcttgaagttttctttca

SEQ ID NO: 38310 - DNA, 276 bp, Neisseria meningitidis
ggcaaaaccctcttaacaattctttgtacacaaatactatggcactggcaataacaatagcaatgataatgctaaagggtaaagagattagtgaatagagaaaactattgcgtaacccaacacaaagttagattcactaaacagatcctgaaaggttcgtaaactaaaggattgggaggagagatcatacagatcactgttagcactaaaacccttctgtaagcttaaaaagaaggggataatggtaaacaaaattgttgttaaaagcgcagggag

SEQ ID NO: 38311 - DNA, 316 bp, Neisseria meningitidis
acctttttcgcttttaggtagtttaagaaaaggttatatgctagatgaaatgctcttagaacagtaaatatttgctacaatcataacgctttagtttttagttgatacaccaaaatccgtagtcaatttattaactaactagtgaactagattttgatgaatagcgctgtaaaatatcctgagctgaagatcaaacttgagtcttatgatagcacccttttagatctcgctattaaaaagatagttgaggttgtaaagggtgtgaacattaagattaaaggtcctttacctttgcctactaaaaaggaagtgatca

SEQ ID NO: 38312 - DNA, 258 bp, Neisseria meningitidis
tcctaagttatttgattactttaaccgaatttgttgatattggtgatcaaattgttgttagtggtaagccaatgttaactaaaacaaaggtattaactttagctgttgaagagatgaaaatcattgctaagtgtttattggttccacctgaaaagtgacatggacttactgatattgaaacccgcgctcgcaagcgctttcttgatcttacctataacttagcaatgcgtgatgtttttctgaaacgcactaagatta

SEQ ID NO: 38313 - DNA, 300 bp, Neisseria meningitidis
caaaaatgaactcacgatccacggaggaggagttgatttaaagttcccccaccatgaaaatgaaaatgccttacacatggctttatataaccagcccattaccaaacattggatgcatattggtcatttgatgattgaaaaccaaaagatgtcaaagtcattgcagaacttcttgttagcagttgattttcttaactttcatgattttcgtgttttgcgttggatcttttaccaaaaacactattagcatcctattgatctaaaccaatcattgattgaaaaagctaataatgatattca

SEQ ID NO: 38314 - DNA, 290 bp, Neisseria meningitidis
aacctagtgaagcaattgaagcagtattgaaatattggagttttcatcaggacttaaatttcattctgatcggtgatgaaaaggcttttgatggtcttgatatacttccaaaaaatattacaaaaaaacttgctaattctttcattgaaatgaccgacactccactaagtgcaagaagaaaagttaacagttcaatgcaaatagccataaacttagttcgtgaaggtaatgctgatgttgtaatttcagcaggctcttcagcagtttatgcttctttaacaaatgatgct

SEQ ID NO: 38315 - DNA, 577 bp, Neisseria meningitidis
caggcatttatctggaaataactgaaaccgaacagacctagattcccgcctgcgcgggaatgacggctgcagatgcccgacggtctttatagcggattaacaaaaatcaggacaaggcgactaatccgcagacagtacagatagtacggaaccgattcacttgttaaagaatcgttctctttgagctaaggcgacgcaacgccgtactggtttttgttcatccactataactaaggaaattcaaattaacttagaattatccctatgagaaaaagccgtctaagccggtataaacagaataaactcattgagctatttgtcgaaagttcaaatttccattttaaaacaattagtaaaatcgagtttatcctaattgtccaagacaacccctataatactataattcagaatataaaaatgggttacatctaaacattacggaatttttattccctcgcctgaattctattgtcagattcaacgagacctcatcatgtcaacgactccaaccttccctacacagactttcaaaccgactgccatggcgttagctgttgcaacaacactttctgcctgc

SEQ ID NO: 38316 - DNA, 515 bp, Neisseria meningitidis
ttgttaatatattttcgcgattaacgtttcttaatattaattcgggtacaatcctttccgctgattaccgctgccgtttctcccttttcggcagtgcagcaagtaagacgttttcccgcaatgtattgaccattcatacttacccttggtatgaatggttttttttgcacgttgaaaatgccgtctgaacgttgggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcaatcaaa

SEQ ID NO: 38317 - DNA, 375 bp, Neisseria meningitidis
aaccgctctgccgtcattcccgcacaggcgggaatccataccttagcacaacagtaatattcaaagattatctgaaagtccgagattctggattcccgcctgcgcgggaatgacgaattttaggtttctgattttgtttttctgtttttgtgggaatgatgaaattttgagttttaggaatttatcggcaaaaatagaaaccgctctgccgtcattcccgctcaggcgggaatctagaccttagaacaacagcaatattcaaagattatctgaaagtctgatattctacattcccactttcgtgggaatgacgggatgtaggttcgtgggaatgacatggtgcaggttcatgggaatgacgtggtgcaggttcgt

SEQ ID NO: 38318 - DNA, 596 bp, Neisseria meningitidis
gtgcgccgattttccaaatctgtttgaacaccgcccaatccggtttgccgaatttcgccgtcagtccgaatgggcggaagaaattttccttggcgatatgaatctcctttggccgagtctgccgcttctcgatctgtttcggcgccagtccgcagcctgcgccgcccaaagcgggcataccgaatttgccgtaaacgaaaatatagttcagcggcacgttcaacacaaacgccgcaaagctgaccaacataatcaggcgcgggcggttcaggctggaagtgtaggcgtgcagcgcgcggtgtaccattgccgccggcatcgccaagctggtgaacaacatatactgcgccatcgtgccttccacataatcgctcaaggtcagccagttgcggaaggcgtaatcgccgcccacatcaagaccatgccgaacacgcccaaaaacagcccgaaccaaatcccctgccgccccgtttcgcccacttcgtcggttttacccgcgccgtaaagctgggcaatcatcgggttcagcgccgccataatgcccataaaggtaatataaaccgtggcaaacgcgctgctgcccaaagccaacgccg

SEQ ID NO: 38319 - DNA, 302 bp, Neisseria meningitidis
  misc_feature (1)..(302): N is any nucleotide
aaattattttattttgttatgaaaaccttcgaaaaaacatggtctgcacaatatcgggatatggaaatttcagtacggaatttttggaatttggagcggacaagggcggaagtctatatcaacggaaggcgggtttatcataacgaagccgaaatggcgtctgcttctttgcgttagctaatgggggaatacctggaatttgaagaaagcggtacgaaaattaccgttgaaatcggcagcgcgtggcattttaatgaaactataagaaatattaatacacatttaangaggtacganacttc

SEQ ID NO: 38320 - DNA, 734 bp, Neisseria meningitidis
aaagacggcgttgatggttttaacatttgcgctcattcggatttgagccatggcaatcttcctttaatgtggtggaaatcatgagtgttgccgacactgtactgctgcctccggtcgaactgccgtttcgggatatggcagacgcatccttcctaaccgcatccgaatacccccaaacctgaccgaatgcaaaactgctgccggaaacggtttgtatgacacttctactactggatgttgcgggcgcattataatatttttccatccgtcttgaaacatttatttacactttatttacactgcggcggcaaatcggtatacgagcgtcaatacacgttaaaatggcgttttgcaccagtttgggagtgatgatggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcg

SEQ ID NO: 38321 - DNA, 758 bp, Neisseria meningitidis
ctagaggatcccgtaggcggtgctacagagttcttgaagtggtggcctaactacgggtacactagaagaacagtatttggtatctgcgctctgctgaagccagttaccttcggaaaaagagttggtagctcttgatccggcaaacaaaccaccgctggtagcgtgtgttgttttgtttgcaagcagcagattacgcgcagaaaaaaaggatctcaagaagatcctttggtaccgagctcgaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctctccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgccccctgacgagcatcacaaaaatcgacgctcaagtcagaagtggcgaaacccgacaggactataaagataccaggcgtttccccctg

SEQ ID NO: 38322 - DNA, 692 bp, Neisseria meningitidis
cattccatagtttgcctttttactctgttaattgtgtcttttggtgcatagcagttttaaagtttgatatagtctcacttgtctatttttgcttttgttgcctgtgctattggtgtcatatccaagaaattattgttatatccaatattatgaagctcttcttctgtgttttcttctaggaattttatagttttttattttaatgtttaggtttttaatccatttagagttaatattttgcttatggtgtaagataaaggtctaatttcacttgtttgcatgtggatgtccagttttcccagggccatttgttgcagattgtcctctcacccattctttctcacctttaacactgctgtgaatggcctttattttctaccttacaccatttgactctctccttcctagaaaaaaacctttctcaatcccacttaaactcatttagtggattgcattggtctggattatcagaggtttctgtaattaggttggctgtgccaataaatatcttcatggatatcctgaatttgttttgtataaagaagaaataggcagatgacattggtagtggatcggtgagaaatttgcaataaaactcaaatgtgcaagatgtgccacatttgtgtttcttttcctcaaattacaaatattggatttgccctccatccgtcacaatttctgggcaattcaaa

SEQ ID NO: 38323 - DNA, 174 bp, Neisseria meningitidis
agcatgggcagcgtatcggcggcggcggcaagaaagctgcccgccgcaaacacgaccagtcccgcataaatggttttcttgcgcccgaacttgtcggaagcgatgccaaagggaatttgaacaaaacccggggcaaccccttaatggccaatggcaaccccgacaacggtttgg

SEQ ID NO: 38324 - DNA, 501 bp, Neisseria meningitidis
cgtctgaaggcttcagacggcatttgtgcgtttgtcgggcggtgtttagggggcggtaacggcgtgtttcggcactttgtccatatcccagtgtgccaccgcccagtcgagcagttcggcagggcggtcggtttccggtgcttcgggcagcttgaggtaacggaacacttggcggatgagttgttcgcggcggtttaaagccaatgcgggggcgagcgtctgtttcgaccagttctgcccttgtgcgttggtcatcagcggcaggtgggcatattgcggtgtctgaacgtccaaacactgctgcaaataggtttggcgctgcgtggcaacgagcaagtcttgtccgcggacgatgtgggtaacgccctgttcggcatcgtcggcaacgacggcgagctggtatgcccagtaaccgtctgcacgacgcatgacgaaatcgccgatgtcgctggccaggttttgggcgtaaccgccgacgatgccgtctgaaaagccgataat

SEQ ID NO: 38325 - DNA, 250 bp, Neisseria meningitidis
gaatgacatattcataagtttcccgaaattccaacataaccgaaacctgacagtaaccgtagcaactgaaccgtcattcccacgaaagtgggaatctataaatgaaaagcaacaggcatttatcggaaataactgaaaccgaacagactatattcccgcctgcgcgggaatgaccgctgcagatgcccgacagtctttatagcgggttaacaagtgtcaggacaaggcggctacgccgcagacagtacaa

SEQ ID NO: 38326 - DNA, 1082 bp, Neisseria meningitidis
agcatggcgcacagcaatgccgtctgaatacgcctcccgctcggtacacggcgagatcggcaatggcagcggtactttggccgccgatatgcttaagttcagtaaccttacgccaccaaaacccttgctagctaagggttaaacagctcacttgaaatctacttaagtctaatctaaactatccaatatggatagatttttaaacatagggcaagcagcaaaattattgtagctgaaagcacaatcactcgctggtggtctcaaacacgtgccgactacctcgccgaaaacactatcagccgcgataaaccgtgggaaaagctcgttatcagccgccgcacttggtactatcgcgggaaaccgatgctgtctgaaacgcaacaggagaaaaataatgagccgttacctgattacctttgatatggataccaactgcctgaaagacaattaccacggaaataactataccaatgcctactccgatattaaaaccatcttggctagacatggatttgagaacattcagggcagtgtttatctaggccgtgaaggcatcagtgaagcacacggaacaatagccattcaggaactgaccgctcggtttgattggttttactcctgtatttcaaacattaagttttaccgccttgaaagtgatttgaacgcacaatttatcgctgatggtgtgtatcaagccaaacaggctttccttcaacgtgttgaacaacttcgtatatccctaacagaagctggattgtctgatgagcaaatcaatcaggttctggaaaaacagaaatttgaattggaaagtcctaacctgaaattaaattaacctcctttactcaccaacatccgccgcagctctgtcagtttttggcgcgctgcggcgatttctgtgcgttttagagcttcgggtasggtgtgaaacaactcactcgaaatttacttaagtctaatctaaactatccaagcagtaattagtacawaaaaggcaaacttattttaggagtttaaaattgcagctgcgataaaccgtgggagagtctcggcatttcccgcgccactttgtacaaacgtggcaa

SEQ ID NO: 38327 - DNA, 615 bp, Neisseria meningitidis
catatagccgatggtatagatatgcaccatcaacgacacgcccgttaccacgaccatcatcatcgccgtcatcgtatcgaccaagaagccgacggagaaatccaagccgcccattgtcagccaggtatagacattctcgtcaaacgtggcgcggctgccgtcaataaagccccacagcacataagccgacagcacggcggacaccgccacgccgagtatcgtaaccgtatgcgcaccggcacgtccgattttgttgccgaacaaacccgcaatcagcgagcctgccaacggaacaagggcaattatcaaatataaagtcatatcgttcatttgattgaatccgattgatttaaaaatctatgtttgtttcgtacaaaattacttcggaaaaacaaatccaacacgctccaatcgtttgcgtgccacagctaattgctcttcagtaaataaatcacaccacggcttttgtaacaccagatattccatactgtatttcaaggcgtggactccgccaccactcaaaatcagcttgctcggcggcggttagttcggagatgaccactttgtccccctctttcaacccgctttttacttcggtattcatactgtctctca

SEQ ID NO: 38328 - DNA, 381 bp, Neisseria meningitidis
cttcaaccatgccaaaacgggcaggacggcggttgtcgacttgctcatcaacacgcccgccatccaagacttcatcctgaagggcgacctgatgaacatcagtaaaatcatggaaaccgccaaaaccgacggaatgcagacgatggatcaaaaccttttcgaactgtaccgtcacggcatcatcagttacgaagaagccctgcgccagtccgtttccgccaacaacctgcgattgcacatccaactgcacaaagaaggcaaaacgcccgaactcctttacgacagggtcaacggtctcaacctcatttcctgatccgcaaaacccaatgccgtctgaaaaccgcatccccgttttcagacggcatgattttatccgtccgg

SEQ ID NO: 38329 - DNA, 236 bp, Neisseria meningitidis
cgaacagtcggcattgcgccccgaattgtggcaggcgttccgaccgttggggctgacgcatttggtcagtatttcgggtttgcacgttacgatggtggcggtgatgtttgcgtggctggcgaagcggctgcttgcctgttccccgcgccttcctgcacggtcgcgcgtgtgggttttgcgggcggggtgtgcatgcgctctgttttacgcgctgcttgccggtttttccgtgccaa

SEQ ID NO: 38330 - DNA, 397 bp, Neisseria meningitidis
atagcggatgtggtcaagtgtatcgacgaatacagcaaccgcccgcacggcgagctgccccgacatcctgacggcgggcattatacgcctaaggcttatcgggaaatgagcctggaacaggacggtatcgcgccggatatgctgtcggcgcaagagctggcgacgatgtttatcccgcaagaggtgcgaaagttacagcgcggctggctggatcatgcttaacaactcttatttctcaaccgagctggcggagtatcacaaagacgaggtacgggtcagctacgatctgagcgatgcgtcggcggccaatgtgtttgatatggacggcaagtttattactaaggcgcaggccaacggcaatacccgcgaggctttcccgacggctcgtatcgaccgg

SEQ ID NO: 38331 - DNA, 386 bp, Neisseria meningitidis
cctgggttcatcgtcttcttcccaatctgaccccaaacattcgccttttggtttgacgtgatgacaggtaaacatacctttatttcggtcttcacgggcttggttcgggctgtattcgccgttgaaaaagtcttttgcgatgtcaacgcgtgtgatttttgggcggattgcattagtcaggaatgagaaaagtcgtgattcccagccttcttttgcgacgccgcaaccggtgccggtcagttcgaaaagaatggcattttgttggccgccaaaatggacgcgaccgtatagggcgtcttccgaacccatcaaccaacagagctcatacatacgaccgcccgaaactttggattctttgtagataccggaaccgacaacttcttcgg

SEQ ID NO: 38332 - DNA, 318 bp, Neisseria meningitidis
ccggcatcctgcccgaagcgatgctcaactatctggcacgcttgggctgggcgcacggagacgatgagttcttcacaatggaacagttcatcgaatggtttgatttgaaagacgtttccccgtctccaagccgtatggacttgaaaaaactctactggatcaacggagaacacatcacaatcacacacaacggcaaactcgccgaactcgtcaaaccccgccttgcgttgcgcgatattcatgaaaccgaagaacctgctttggaagatgtgttggaactggtcaaagaccgcacccaagacttggtcacgcttgccg

SEQ ID NO: 38333 - DNA, 471 bp, Neisseria meningitidis
cgcccaagagtgcggacatcggtacgaaatgcgcgtctttcaaaccgagctgttcggcaagtcggcggtatgcctccacaatggcgttgaatttgtcttcgctgtaatccagcaggtccattttgttgaccgccaccacaatatgcgggcagttgagttggcggaggatggcggaatggtgtttggcctgcggcagaagctgcaagggctgcgcgccgaaatccagttgggatgcgtcaaccagcacgactgccgccgaagcggtgcttgcgcccgtaaccatattgcgcgtgtattgttcgtgccccggagtgtcggggatgatgaatttccgtttcgccgtggaaaaatagcggtatgccacatcgatcgtaatgccctgttcgcgttcggcttccagtccgtcggtcaggatggcgagaccaatgccacggtttccatgccgtctgaaaccggcgcgcccgttcccgt

SEQ ID NO: 38334 - DNA, 177 bp, Neisseria meningitidis
atctgcttttttcaccgcgcgcggtttgccgtctttattggtaaatttgggcggatcgattatgctgcccacaagccggtaatccacttcgaatttatggcatgaatgatgaatcaaaaaccggttgaagccgtttttgctttgggcgatggtttgcatattcaaaaaatcgccaat

SEQ ID NO: 38335 - DNA, 681 bp, Neisseria meningitidis
  misc_feature (668)..(668): N is any nucleotide
caggatccttggtggcctcctgcacgggttcgggcaggcttaaaaggcgcaggctgttggaaatcgcgcttcggcttttaccgacggcttgggcgatggtttcgtgggtcagcccgaactcgtcggcaaggcgtttcaagccttgtgcttcttcgatggggttgaggttttcgcgctggaggttttcgatcaaacccattgccaatgcggtttcgtcgctgatggttttgataacggcggggatttcggtcaggccggcaatctgtgcggcgcgccaacggcgttcgcctgcaatcagttcgtatcgggacagtccgtgttcgcgcacgatgacgggctgtatcacgccttgcgccttaatcgaatctgccagttcctgcaaggcttcgtcatcgatttgaacacgcgcctgatagcggccgggccggatatctttaaccgcaaccgtggtcaatcggtcgccgctgctgttgtccgcgccgttggcgagcagcgaatccaagccgcgccccaatccgccttttacttttgccataccgccctcccgtgcctattcagataggatgttaaatcgggtattttatcggatattgggtgttgccgacaatttgtatccgcgtttatcggatttctgttttttcactataatagccggtttgccgttgcangcggttttatggg

SEQ ID NO: 38336 - DNA, 668 bp, Neisseria meningitidis
  misc_feature (1)..(668): N is any nucleotide
gcctgtatgctcttctttgaaagtttcgtatacgtcatgggctaaaagggctgttccgacataaggaactgcccttgtgcttaatttcgcgcctaagcgggcaagtttgccgacccccgccaatacgccagcgcgggaaactgatgaagatacaaccgaactaactttacccgtacttgatgctccagtagatacatgcctaacttttaaatcttgagcttctgaagttaaatatcttcccgattctctatcaaatacacctttccaaattcttcttcttttgtcatctgaacctcgaatacctaanatagtggaanngntccgacagcagagtcccaagaaaattacccggagcatttactgatgccaatgcaaatttagatacaaaaaaactaaagcataggataatctttaaaaaatttcgccctaggataataaacataacattttgcttcatctaatttaattaataatgtagaagaatcagggaattgaatttctataaaatctctatcataacgatgaaagaaattcctaaaaatatcaaatgaaaacgaagttttaaaaaccccttttctaatcaattccctataataaattaacgcttgtggtaaatctctataaatatgtgaatcagtttgaaaatttaactaaatgatattcagaaa

SEQ ID NO: 38337 - DNA, 598 bp, Neisseria meningitidis
tgaatatccagtccaaccttgacgaacccttttccggcagcattaccggtaaccgcgcgaagaagccaaagccctgctaggcggcggcagcgttaccgtttccgaaaaaggcctgaccgccaaagtccacaagttgggcgacaaagccgtcattgccgtttcttccgaacaggcagtccgcgatcccgtcctggtgttccgcatcggcgcatgcgacttccaaccaaaccgcaccgccatcctcgatcctgtcggctactcgcccaaaaccaaatctgcactttcagacggcaagacacaccgcagcagaaccatttatgcagagtcccaagaaaatcaaaacgccaaatcccataccattaatcagaattcttcctattttttcgaatccactatttcttccaaagcggcaaaacccataccgtccgcaaaggcgaaacggtcaaacagattgccgccgccatccgcccgaaacacctgacgctcgaacaggttgccgatgcgctgctgaaggcaaacccaaatgtttccgcacacggcagactgcgtgcgggcagcctgcttcacattccgaatctgaacaggataaaagcggaac

SEQ ID NO: 38338 - DNA, 366 bp, Neisseria meningitidis
cgttgttcggttcggttttcgtcataccaaattccttatttcttctgtctgagatttatgaattatttgtgcagcccgcattctttgctgtttctgccttcccaccaccaccgcccggagcggatgtcttcgcccgccttgacggggcggatgcaggggtcgcagcctatgctgggaaatccttgacggtacaaatcgctgtgaggcacattgttggagaggatgtatgcccacacgtcgtgttccgactagtcgaaaatcgggttgtatttgccgatgccccgtccggcatcgtattcggcatacagcagttccgtgcgtgtggcggattgttcgcggcgttgcccggtaagccacgcgtccgcg

SEQ ID NO: 38339 - DNA, 861 bp, Neisseria meningitidis
tgtcgcgctgacgcgtgccgaggaacagctcaacatctattcsgcgtactctccaakacsgcaaaaacaaccccccgcctacwtgattgaaggctcgccagacatscgcgggaatgacggcatttctgcggcaatcggattatttccaaaccaaaagcgcgtggttgcgtttgccgcgccgaaggatagtgtatttgccgaaacgtttgtgttcgccgttcagcaggcaggcatcgtcggggcgttcggcggcgtggttggggttgttggcttcggcaggtttgccgttgagcaaaaccgctttgctgttcacaaagccgcgcgcttctttattggaggatgccaaaccggtttttaccaaggcttcgacgacattgatgccgtctgaaacttcaaatgcaggcaggccgtcgagggcgagctgctcgaagtcgctttcggtcaggctgctttggtcttcggcaaacaggctttcggaaatgcgttgcgcggcggcaagggcttcttcgccgtgaatcaggcgggtcatttcttcggcgaggatgcgttgcgcttcgggcttgctgccgcttgccttgtctttggcttcgatggcatcgatttcttcgatggacaggaaggtaaagtatttcaggaatttatacacatcggcatcggcgactttcagccagaattggtagaactgatarggcgaggtttttttcgcgttcagccataccgcgccgccttcggttttgccgaatttggtaccgtctgatttggttaccaaaggcagggtcagaccgaatacttgtttttggtgcaggcggcgggtcaggtcgataccggcggtgatattgcctcattggtcggagccgccgg

SEQ ID NO: 38340 - DNA, 756 bp, Neisseria meningitidis
taccgcgcacgggcgtttgaaatagaaaccgatcaagagatacgacaccaagcccaccgcttcccaaccgaagaagagctgaatgaagttgttgctcataatcagcatcaacatactgaatgtaaacaaagaaatatagctgaagaagcgttggtagccgactttttcatcgtgcatatagccgatggtatagatatgcaccatcaacgacacgcccgttaccacgaccatcatcatcgccgtcatcgtatcgaccaagaagccgacggagaaatccaagccgcccattgtcagccaggtatagacattctcgtcaaacttggcgcggctgccgtcaataaagccccacagcacataagccgacagcacggcggacaccgccacgccgagtatcgtaaccgtatgcgcaccggcacgtccgattttgttgccgaacaaacccgcaatcagcgagcctgccaacggaacaagggcaattatcaaatataaagtcatatcgttcatttgattgaatccgattgatttaaaaatctatgtttgtttcgtacaaaattacttcggaaaaacaaatccaacacgctccaatcgtttgcgtgccacagctaattgctcttcagtaaataaatcacaccacggcttttgtaacaccagatattccatactgtatttcaccgtcattcgggacatttccgccctgctcggcaaaccctttgtcgcacctgccaaaacccaagccaaagcactcgcccggataga

SEQ ID NO: 38341 - DNA, 376 bp, Neisseria meningitidis
agaatacgcgcgggtcagaacacgccgaccaccgtccgggttttgtcgttttgaaatattcctctaaatacggcaggcggtttttatcgacggacaaaccggttttcacgcccagtttgctcaaggtgtcgagcatacccaaatcgtaaacggcgatgcgttcggggttttgcggtatttgaacgtcgccgcgcgcggttttgacggtaacggacgcgccttcggtttgtgcggcggaaaccgcctgttctttggcttgtggggcagagtcggaattttgcggcgaacacgcgcccaaagcgagggcggtgcatacggctaaagcagtcaaacgtaacatacgtgtctccaaaatgggggatattggggcaaagcc

SEQ ID NO: 38342 - DNA, 635 bp, Neisseria meningitidis
tactctagaaggatcccccggctaaagaactcggctacgcctccgacctcgacctcgtctatctctacgacgacccccaccccgacgcaggcgacgtgtacagccgcctcgcccgccgcctgaccaactggctttccgccgccactggcgcaggcagcctctacgaaaccgacctgcgcctgcgccctaatggcgacgccggtttcctcgcccacagcatcgccgcctttgaaacatactagcgcgaaaacgcctggacgtgggaacaccactcgcttacccgcgcccgcttcatctgcggcacgtccgagattcaggcggccttcgaccgcatccgcaccgaaatcctcaccgccgaacgcgaccaaaccgccttggcaggcgaaatcatcgaaatgcgcgaaaaacatgttccccacccacccgcctgccgacagcaacgtcaaatacgcgcgcggtggcgtggccgatgtcgactttatcgtccactatctgacacttgcccatgcccgacagtatccgcaactcttggacaactacggtaccatcgccctcttaaacatctccgccgactgcggtttgattgacaaaaccctcgccggccacagccgcaccgcctatcgcttctaccgccg

SEQ ID NO: 38343 - DNA, 622 bp, Neisseria meningitidis
aattccagctcggtagcattacgaattcgagctcggtacccagcacaaccccttacatgtaccttgtgtggtgtcattggatcctagcaagaaaggtatccatttgttccccacaaaatctttatcatgcacgattgagtaggatccgctgttataagttttgccgtctgcacccgtataggtatagccgtttttctgtaaaacatcggcgtaatcattctgcacatttgtggctgtaccatagaaacgtgcttttctgattggggcaatgccattttgtttttgattgtttacccaatcttttaaggaaacgcttgctgtaattcccccacgactgtgattactggtatcaaccgaccagccgttacccattttttgaacctctcgataaatatcttgattcagtttttctgaattggttttgagtaaatagccttggcacactttattatttaattggtcgtaaccgacatacatcagttcagaaacaagacttgcaccgagccataaaaaatcttttattttgttattagaatcagatttatatttccctgttggaggattcatgactgcaataagcacactaccgtttgtactaatacgatgttgttttgctgcgttg

SEQ ID NO: 38344 - DNA, 103 bp, Neisseria meningitidis
gtactatccgtactgtctgcggttcgccgccttgtcctgatttttgctgattcactatatcgacatcgccaaacgagacttcgtcatcgccgtttcgtctttg

SEQ ID NO: 38345 - DNA, 2159 bp, Neisseria meningitidis
aatagattaagatataactattaaaatatttttagataggattatcggaattaaagtcttttatacccagtcgtccgatgcggtttatagcgtattgttgctatatgttcgttatgttatataacggttgcatcaaaatttacgcccacaggctttcccgacggtttgaaagtttgattttcgataacttggagacttaaacaatgcctacccaatcaaaacatgcgtctatcaatatcggtctgatacaggcaagggaagccctgatgacccaattcaggcctattctgaatcaggcgaatattaccgatcagcaatggcggattatccgtcttttggcggaaaacggcacgctggactttcaagatttggcgaatcaggcgtgcattttgcgccccagcctgaccggtatcctgacccgccttgaaaaagcgggtttggttgtccgcctgaaaccttccaacgaccaacgacgtgtttttctgaagctgactgccgagggcgagaagctgtatgaggaaatcggcgaagaagtggacgaacgctacgacgctatcgaggaagtgctgggccgcgagaaaatgctgctgcttaaagacctgttggcagaacttgccaaaatcgaggatgcgttgaactcgtaatacgccgtaacgcgcggaaacgtccgaccgacggctttttgaatcaaaactgctgcacatgggggatgccttgtgtgcagcattcttatataggggacagtttaaaggggaaaaatggcggatttgcagaaaaattttcaaacttcgttccgtgatgcgatggcatcttgcgcggcaggcgttcatgtcatcacgacagacggtgcggcagggcgttacggcattacaatgacggcggtcgcgccggttaccgacgagccgccgaccgtgatgctgtgcatcaaccggagtgcgcgaatcattccgatcctgtcggaaaacggcagcctctgcatcaatacgctggcggacgaacatcaggatgttgccgaacattttgccgggctgaccggcctgtcgcccgaagagcggtttgcctaccacatctggcatcgcggcaaaacgggacaacttgaaatagagggcgcgttggcgcacctgcacgggcatattgtcggcaaacatgaaatcggcacgcattttgtgttttacgtcaggctcgacgaaatcaaaaactgcgggtgcaaacgccccgcgctgctgtatttcagacggcagtttagatttttagactgatattcggacagatatatgaaagcgatgatactggcggcaggacgcggcgagcgtatgcgccctttgaccgataccactccgaagccgctgctcgatgtggcgggtaagcctctaatcggttggcacctatgccgtctgaagcaggcggggtttaccgaaatcgtcatcaaccacgcttggctgggtcggcagatagaagatgctttgggcgacggctcggcttatggcgtgaacatcgcctattcgcccgaacccgcaggcggtttggaaacggcaggcggcatcgcgcaggcattgccgctgttgggtgggcagccgtttttggtggtcaacggcgacgtgctgaccgacatcgattttaccgccgcgtttcagacggcatcgtccctgccggaacatatttccgcccatctgtggctggtggaaaatccgccgcacaaccccgacggcgatttttccctgctgcccgacagcagcgtgcggccggaagtaaatggcggcaacggattgacattcagcggcgtgggtatttaccgtcctgaaatgtttgacggaatcgaagcgggcagtgtggcgaaactcgcgcccgtattgcgtggcgaaatgcggcaaaaccgcgtgagcggtcagaagcatacgggcttgtggctggatgtcggcacggtatgccgtctgaaagaggctcaagcccttgcaggggcttggaagtaaaaacccggtttcagacggtatggcggattcggtttaacgtttcaacgccagcaccaacacgcccgccgttaccagccccaagcctatccattcctgcgtgttcgggcgttcgtccaagaaaaccaccgccatcagcgcgaccaagaccaggctgaatttgtcgatgggggcgacttgcgaggcgttgcc

SEQ ID NO: 38346 - DNA, 543 bp, Neisseria meningitidis
cccacaggaaaaacggtcaatgctttcagcgggatttttttggggaaattcgtcatgtcgctgtcggataaggttttttatttctgctaaatactgcgccgcctccaacaatcctttcctctccctcctccggctggtgcgcctttgtgaatatgctgtctgaaactcggggactcagacggcattttgtttgccgccatcagtcggcaaactgttttttcatcctctctcggcgttcttgggactcaacagataaagtggctgtcgggcgtgccagcagccgcttcaaaccgataggctctcccgtatcggcacagaatccataatccccttcatcaatattgcggatggtcgcctgtattttactgagaagttttcgttcccgatcgcgggtacggagttccaatgcgtactcttcttcctgtgtggcacggtcggcaggatcggaggctgattcgtgttcttggagatgccctgtcgtagcggaagcattttcgatgagttcgtcttgcatttttactagcaattcgcggaaaaaagcta

SEQ ID NO: 38347 - DNA, 125 bp, Neisseria meningitidis
aaagctggcttgcccgacactcagacggtctccccgccggcatttccacgccgcaaccctacgggcgcaaaagcccgaatcaacgccaaaataaccgccagcgtaacccgcgccggcgtattggc

SEQ ID NO: 38348 - DNA, 252 bp, Neisseria meningitidis
  misc_feature (216)..(216): N is any nucleotide
caaaatacccttataatgagctttatgtagccaatcctaaatcggggacgagtagtttggtgcgaaaacaaaacgggtaaacaaccgccgcctgccgccgtatatgctggcgcacggagtcggcgtgcagctgtcccatacttaccgcccaaacccgggatggcaattttcggtcgcgctggaacattaccgccaacgctaccgcgaacaggatanggcggaatacaataacggcaggcaagacgggtttta

SEQ ID NO: 38349 - DNA, 915 bp, Neisseria meningitidis
taaatttgttgttgtccgatccggttattgtttgttctgacttgtattttttccgtgagtctcgcccgtaaggcggaagtggcgggcaatgcgtggcggaatgtgggtaaaggcggcattttgatttgtcggaatgcttgagaacccctctctttaaaacacccttggattcggatttcaagtgcaacactagtgtattagtggttggaacagattcaagaataaaacacttggcgtttcgtagccaagtgtttttcttggtcggtggttcaactcatcttgaaccctgcgtatctcccgatcactgatgttacggaaatcggtttgtttggggaagtattgccggatgagtccgttggtgttctcattcagccctttctcccaagaatggtaaggacgacaaaaataagtctccgctttcaatgctttggttattttggtgtgttggtagaactctttgccgttatccatggtaatggtgtgcaccctgtctttatgtgcctttaatgccctaacagctgcccgggcagtgtcttcggctttgaggctatccaatttgcagatgatggtgtagcgggtaacgcgttcgaccaaggtcaataatgcgcttttctgtcctttgccgacaatggtgtcggcttcccaatcgccgatacgggatttctggtcgacgatagcgggtcggttttctatgccgacacggttgggtactttgcctctggtccatgtgctgccgtagcgtttgcggtagggtttgctgcatattctgagatgttgccacaacgtgctgccgttgcttttgtcttggcgaaggtagcggtaaatggtgctgtggtggagcgtgatctggtggtgtttgcacaggtaggcgcatacttgttcgggactgagtttgcggcggataagggggtcggg

SEQ ID NO: 38350 - DNA, 162 bp, Neisseria meningitidis
tatttcgggcgtgatggaaatccagtcgtcccgatggcatgaacacgcctttcgccttacgcgatttgagcaggtcttcggtggcggcagagccgatcaggacgcgccctttgcccacgggctgtttggttgccttgctgtacacggttacggtgtccatac

SEQ ID NO: 38351 - DNA, 410 bp, Neisseria meningitidis
gccattttgtggcattgttttgcgtataccgtgcaagatagccataggggataaccattttggtgccctgaaaatcaaatgtaaccgtatgttcaaatcctgtcattggctcgggattgttgaaactggtttgttcattaaagggtcacatgagggcatagttaaaacactccccattaaccaaattaaaagttgataaatgggaatagcctatgggcccctaatttcaagcctaggaattaggtaaaggatatattcctgggagataccaactccttaggtaaaaataatttaccaacctttggcacctagggataaattcccatacctaactaaaccggggggaaatatatttatcccaggttggaggggaacctttttccccggttccggcaggataggtacggggt

SEQ ID NO: 38352 - DNA, 354 bp, Neisseria meningitidis
ctgccgaagccgtccgcctgaaccgcctgacacacggcgcgctggacgtaaccgtcggccccttggtcaacctttggggattcggccccgacaaatccgttacccgtgaaccgtcgccggaaacaggaattggtcaatagtcacttgcgcgccgttggcgaagtcaccgaattgagcttcccaaatggtcactttgtcacgtgcggagcaagcaaagccgtactcgaacgccatcacggcttcttcgttcaaaatggagtcgataaccaggaactcgcccatgccttcgcccatatggcgcagaggaacataagtatcgtcgtcccaattttcgcggttttgatcgtgcaatac

SEQ ID NO: 38353 - DNA, 558 bp, Neisseria meningitidis
  misc_feature (280)..(280): N is any nucleotide
  misc_feature (464)..(464): N is any nucleotide
caatgcattgggcggcggtgtgaattaccaaacgctgcaaggccgtgatttgctgttggacgacaggcaattcggcgtgatgatgaaaaacggttacagcacgcgtaaccgtgaatggacaaatactctcggtttcgacataaacattcaataataaaacaagatcacataataaaaaaaataatgaaaatatgaaggataataggagggttaagttatttaatgggacttgttctctatgaatcataagacaccaaataatccatagtacgtttagcanataaaaactaccgatgcctaacctctttttctcagaacctattatcattagaattctaagtggaaaaatagaattaaaaaatttttttcttcgctctgtcgttaatgtatccttagttttccctaaaaaaaatataaacatatatatactgcacaatattggtaataaataaattaaaagcganaggtaattaaattgataattgtaaattatataataaacaacatacgaagaaaaaatattatagatgatttgctatacgaataaaaaaatatcct

SEQ ID NO: 38354 - DNA, 413 bp, Neisseria meningitidis
gcgtgtgggacggcaaagcctacgacgacaacagcagttccgcgaccggcggcagggttcaaaacatttacggcgccggcaggctgctacgttttcagctacggtttcttttgcacgcaaaggtttgattgattggaagaaaggtctcccgattgccgcagcatcgtttgtaggcggcgtggccggtgcattatcggtcagcttggtttccaaagatattctgctggcggtcgtgccggttttgttgatatttgtcgcactgtattttgtgttttcgcccaagctcgacggcagtaaggaaggcaaagccagaatgtctttttttctgttcgggctgacggtcgcaccgcttttgggtttttacgacggtgtgttcggaccgggtgtcggctcgttttttctgattgccttta

SEQ ID NO: 38355 - DNA, 409 bp, Neisseria meningitidis
tacctgcgcgcgttttcgcaggcggaaggcaatgtgcgcggcggcgaggtcatcggttttgtcggttcgaccgggcgttcgaccgggccgcacctgcattacgaggcgcgcatcaacgggcagcccgtcaatcctgtttcggtcgcattgccgacaccggaattgacgcaggcggacaaggcggcgtttgccgcgcagaaacagaaggcggacgcgctgcttgcgcgcttgcgcggcataccggttaccgtgtcgcaatcggattgaagtttgaaccggcgacgaaaacaatgccgtctgacgacgtgtatggcatagctgacacgctgagcctaagtgataccgataccgagatttttatttacatctttataggcgagatccacagattggatacccaaattttcaa

SEQ ID NO: 38356 - DNA, 249 bp, Neisseria meningitidis
ccgcaggttctggcaaaaaccgaaaaactttccaaggcgggctcgttgggcaaatcggaaatggaacggtatcaaaattgggcataccgccgccagctggcggatgctgccgatgccgccgcttagaaaacctgcctgaagcggattcccgacagcctcaaaaacggggaattgagcgtatcggatgccgaaaagcacgaacgcttgggactgaatgccgacgcggccaaatgggtcaaacagcattat

SEQ ID NO: 38357 - DNA, 669 bp, Neisseria meningitidis
  misc_feature (431)..(431): N is any nucleotide
ctcggtaccttcgtaatattatgagctatgaattcgacctcggtaccctgtgcactttcaaagtatacaaccaaataaattaataataaggcaccaaatacaataaacaacgccgtaagcatgctcatagaaccttggttcgtcagtgtaaccagctttgcaatacccgaaggaatacctgaagcaatacctgccgtaatgattaaagaaataccgttcccgatacccctttcagtaatttgctccccaagccacataagaaacatggttcccgttaccaaagaaactaccgtggaaacatgaaactcaaatgaacttgttacaacaattccttgctgaaatacgaaagatgcaacacctagactttgaagaattgctaacaaaacagtaccatacctagtatatttcgtaattacctttctaccagcctncccttctttatttaaagccttcaatgatggcaaaatttcagaagcgagctgtacaataatagaagctgaaatatatggcataattcctattgcaaatatactaaagcgctctaacgacccaccggaaaacatattcaatattcccaggatgccgtttccagcgctttcgtataatttagctaaagcaacagcatcaactccaggtacgggtatatgggcaccaattcgaaaaacaatc

SEQ ID NO: 38358 - DNA, 330 bp, Neisseria meningitidis;
aaaaagtggtttcagactaagaatgacgcaatcggcatttaggccgtctgaaatcagaagtaccgtttcccaatatcgaaaatccgccatgcggctaaaaatacttccttcatggagcagaaatgactttgttgagcttatttaatccgttgcaaactgccggcatggaacaagagtttgatgccattaaaatcggtattgcctctcccgataccatccgctcatggtcttatggcgaagtcaaaagacctgaatccatcaactaccgtacgttcaaacctgagcgtgacagtttgatctgtgccaaaatctttggcccggtcaaagact

SEQ ID NO: 38359 - DNA, 466 bp, Neisseria meningitidis
acggcttgttcatggttctgcctttcaatgattgttttgaaagcctgattttgacaccataacttcatgcgctcaattcttaaacagaaccgccccgattaatacgggtacggaaacgccgagataacaataagaatccatcatttcaaaacctttttcagcagggacacatagtaaacggacgcgaggatgccgaatactatccagcctgtttcaagaccgctttgcacgttgtccttcggactgcattccgccaataaaagccttagcggctgaccgtccgacatcttccacaggctgccgttatattccggcctgacaatctgtccgttttctttgattcttggtgactaccaagctgaaatacaggttttcagcctggtgcttctcaagacatttatttccgacttggtacaacatgccgtcttacttcaccactctcttaacgatgggaactacaaaaagc

SEQ ID NO: 38360 - DNA, 555 bp, Neisseria meningitidis
aacttgtatacaaaacctacaatattgtcaatatcggcaattcccccatcaaaatccgccaaatcaaaaatataaaaagggatgtcctcgatgggcatatcgcgtattacttgttcaatccataacttgaattcatttaaatcaatagactgagagaataagcatttaattgcaaatcctaaatcatcactatcctcttttatgattttccacataattatcttcctttgccgtcaaacgctcttttagttacccgctttatatcaaaaataccgtctgaaagacgaatatcgtttcagacggcattttgactgtttaaagcggaggaagttctacaaacggcaagaaatgctgaaatttctgaaacatttcaagatgtatctctaacgcttttactgctttttcttttgaaatacgcagatcatacacatctatcccccttaaaaacgcaatgtcggtcaaggtattttttttcgattttgatagtctgcacattgaaacagaacctacagtattgtcaatatcggtaattcccccatcaaaatccgccaaatc

SEQ ID NO: 38361 - DNA, 344 bp, Neisseria meningitidis
  misc_feature (35)..(35): N is any nucleotide
ggtcttcgccctggttaacctcattaagagtctcncaaaatgctccgggcctacctagtcaatctagtcactctccgagcctccgcgcctgccaaccgtcgtgcaatcagcaatacaaatactaagccctcctgggctgctatcattctagcattcaaactcgctgctttcaggggtacatccttgttaaaggaggttattagtgtcaagttcaaatgggtgttcctcgtcagcggggccctcctccgaaacaactgggccgtaaacttaaggattcaagccctggcctatgggttcttcatcaaagtcaggagtgccgtcaaaatgagtacctgggctactct

SEQ ID NO: 38362 - DNA, 749 bp, Neisseria meningitidis
ctactaaccacaatcccatccttccgtctattgggggttctattccagggttatcttcgatttctcagcgtaaccgcgctttagccagacgtggtccgaaacgaccagaccaagcggctcctccgaagtcgcttctcttccctcgcttcagcgggccaagcgtcctaaacggccagggcacggccgtgggcgaccgtgtaaacactcctacggcttagctgggcgtcgttatcggcgaccaactcctaactacctgcgtcagtaaagttgcaggcggctttagtatcttctgcatagtcgcttttaacctaataagatatctcttccgtacccgcctcatcgtcacatcctgggcccgggcaatgctgtcctcgaacgcactctcgtctataaaagtacatccttggtcctagtccgcggtaatatggtcagccgtactttgggtagatggggtatcatagtctttccgggcgggcttctcttccaacctagaggggtataacgcctcatcatcctaagtaccggaagtcctacggctacgggcatcctcctctacaaccgctgcagcatccggcttctgttctatagagtaaatggtagggtcgttagcggtaccttccctggcacccacagcttcttccgcgtcaaccgaagcttgggcttcattaagattatacctctcctggtgggcgtcctgctattcaaagactgtacggtcattaaagaccccctggttctctgcttgggcc

SEQ ID NO: 38363 - DNA, 439 bp, Neisseria meningitidis
tcctgtcctatccgtaccggcacttgcttctttaacctctccgagtcaaacactcctgggctttcatccgcagcggcttcggcaggggtttcgacggctgctgcttcggcatcctcctaggcatccatccacacttgatttcgttcttcagggctctcctcctaggtacctgcttccgaagcggggctctcctcctccctacaaaccctggtaagctctttaacgtcccaacccacctccgaagttgcttcttcactccgctagggcttagaggcttcttcaacctcggcctcagctttaaagtcctcggaagttctttcaaatctctcttcttcgtaactaccaggttcagctccgtcggggcaaactctcggggtacccaaaagctcggtaaatttaaacttgctttcttccctaagatcctagtcttctgggcttc

SEQ ID NO: 38364 - DNA, 378 bp, Neisseria meningitidis
aagcacggggcttgccggttaaaacggtgtaaggttaggaagagccggggcgtcggtcctaaaagcgcgctgcgcaggcagatcaaaatcaacgggtactcaactgaaaagcctgaaaggtctctatagtgaagatagtagactgatcagaataagttcgagaaaaaactgcgtaccgggtatggcggtatccagaagaccaaagaaacgactccgggcacgaggtccgatgcgaattcgagaaattggattagggtctggtaaaacattcaagatcctcatgggattcctactattctcattctcgggcttgggctcggcgttcttaaaagaatgggtagtgctggtgatggtcttagtaaatagggtgaaagcgcc

SEQ ID NO: 38365 - DNA, 967 bp, Neisseria meningitidis
tcattgctacctagctaactggcctatgccttcgtcggggataatcgtcgcatgcccaaaatttgcctcggatttaatggaagtcttggctactatagtttttgggtcttactgcctcgaagactcaacacctttctattcagtctttggtttaatacggctctacttgcaagcctcaagcctcttgcagctccgaggggtgttggatctagtgcgctccgagggtatattctagagccgctatgtgtacgataagtgctgtgcagcttctagacggaacttacttttcatatttcttaatatttctgcatctctttgcatccctggcgtgctgtttcctagttctggatacataactgcgcattcgtgttcccactgctagcgcgtacaccggggtattcgtagtattcaaatctctcacatcaaacccttgtcgcagatcttgagggggagaccggaagcgtagcagaagaagccgggtggacatcgtaccgcctatggggtccccaaagcgctctccaattttgagggcgggagggggtgaaagataggtaaagagcgagttctgtagcacataagaatttgcagaaagctggtaagaagaggcaaaaaccaacacgagcacgaggtaatagggttcgcgtctttggaggtttggggggctcctaggggcttggttgcgggggctgtatttacaaatctgccgcaaacgaaaacagctgcaacagtacggcccgctatcacgcccggatagtcaatgccagtgtaatactccgaacagttggcacacggggtcttttcaacaatcggggttaagcagcactatggggaaacggtgctgagcgcctctccgaggagtttcgaggcatcttccctaacactaatgtccgtcttctagatatgaggtgtacaagcatggccggcacgatgtattacgtatacaaaactagtggatccagcctagcat

SEQ ID NO: 38366 - DNA, 369 bp, Neisseria meningitidis
tcgttactaacttggtcgtcgcttactcctctacgggggttactcaaaaagttaaagctactctctatagcttctgcggcgtccctactacccgggtccagatcgttcttaaagtcttctcgattacgtacagggtcttcctacagccctccgaggtttgcttctttagggcgaattccggtgcttttcatattagcatcaataacctctacggcgcctgcaaaggcgccagggtccgcccaaatctctttcggttcttcgtctctagttctcataaccgcagctttcaagtcaactccggcagctatagggttacagctaaattccctgcggggcttgctctaagcactctctgcgtccaatacttcg

SEQ ID NO: 38367 - DNA, 437 bp, Neisseria meningitidis;
ggtgcgttccatggtaaaacttcatagaatctagaggggttaaatgcaagggggttactcgggtgggaagatctggccgcgtccccctaggggttttggggggcgtccgggttagctcctccaacgtcaagctcggtcctttgcgaactgctcctccctgcgagattcctctaattcctacccgaccgctggccaaaccgagcagggtgctgggcctggtctcgtctcgggcgcttagttaggtcgggaccgttgtacaattggcccaatatctccacacacttacaaactgcagcacgaacctagacgcgggtagcccggtttgaatcgaacggagggggctgtcctaggggcgcttctggtgctcctaactgtggtgatccaggggctggccgaccgccgcctaagcctctgcaccggtaacagctgctgtggct

SEQ ID NO: 38368 - DNA, 466 bp, Neisseria meningitidis
gcggcggcttcgataatattactcaattcttggtcagaagccggggctttcgagaccgcggcggcttcgctacggctacggcctgcttcttggggggcagtaccttctttcgcttgcaaagcgtcggatccaaccacgacctaagagtccagcgattgggtcgagtcctccgaaacgtcttcaatccaaaccatctcccgttcggtagccttggatttctagttactacgttttacttcaatggctgcgttatcttcatgctattcagcgttgcacttcgtcgtactaatcgccgatctaccggcgtcggctgtagttatcccgagggtgctactactacacttcttcgcttccggatcagcccgctccaaaaccagcggttcctaagggcaagtcccgggcgatcccgcaaatccatctggctggtagacccgcttcatacctattatagcctacgaaggttcta

SEQ ID NO: 38369 - DNA, 466 bp, Neisseria meningitidis
gtccgatttccctggggggccgggggctattgctccaggtcaggatcgtacccgaaagtcgcttggcgcttaattagggcctcggccgaacggggggggtggtcctagtaaagatggtcagaaaggttctattcagcaggggctcggggggtgtccccgtccggatcttcctcacgggtcttagaaatgctttggtcctagtcatcgcgagtatgggtatatttaacggctccctcaatagagttagtattaggggctgggtcggtacctctaataaattcgcagtcatcaatatctaccgtacggccgtcttcagcctctccgcaagtactctcctcctgatccaacacgttatcttcatccatacattgaaaagtatggtcgtctgcttcattgcggtctccaggggcctaatcctggtggtcagcgacggtcctagtcgttactttccggcgctcttctaaag

SEQ ID NO: 38370 - DNA, 437 bp, Neisseria meningitidis
gttagttcgggcttcagggtcccaagggttaaaagtgcggcctcggctcttacgggtaatgctaaagctctgctcattcgagtccggacttcctgcggggtcctaagcttcggcagctgcttcagaagggtcctccccagggggggaggcacgggcctcgaggcggtaaatgctcttaatacccgctcctctatcctggtcaccgtccgaggcttctttcgcgtggtggttatcattcgtgtgagagcccaaatcaatacattctttcgcgtggtaagccgtacaatatcgttctcagatactttggtcattaagatggggattcgcttcgtcccgacgggtaatatggctaccatggcgctcattcgattccgtgcagataccgtcctcctaagtccggtggtgattcttctagtccgggctcttaataccaaaat

SEQ ID NO: 38371 - DNA, 368 bp, Neisseria meningitidis
cggtggctaatagaccaccgacgcctcctccaccgacgtgaaaacggtcaccctcatggtggtggtcgttaatctcggctcgttcatgctcttcttcctcctaaccggcgacttcttggtggtcatcagcaggggtccttagactaggttcccccgcgtcgacacttacaacgtagtcctcaccaacacctcggcggtcctgggccgcagcttcccggtcggcttccggggcctccaggggggcttgagtagcttcggcagcaaccgccatggcttaatcggccccagcttctacagcaacatctctaacccgggagtgagcttggcctccgccccaagtagcctatcatacctggcccgaaggggct

SEQ ID NO: 38372 - DNA, 391 bp, Neisseria meningitidis
cgaaggcttgggccgatcaacataaaacatcgaggaagacaattgagcctgctgatcctcggcatacggtcaggagctcttggagcgttcagcatactacaggttttcaacgtaaacaaggcagccaaacttaaagcgagacctgcctatcgttcggggccaaggcctagaaacaacaatgcaagaaaggaacggtgggccaggccaagaaggggcggggaaagacggctatagggcaggccaatcctccacaggcgcgccgtaagaaaccgcagcagggtacaaagcccctgcagggggtttggaggtctaaggtaaaagataaacaacaaagccagcttaaaaactgccaacacaggggagtcggcaaacgtcagcttaagtttcataa

SEQ ID NO: 38373 - DNA, 461 bp, Neisseria meningitidis
gtttttcgtcttggctcttcgaacattcacgctaacttgtagtttattctctctgaggaccaaaaaagctcagcgtcaactttgcggtccatggtttggttgtcattgtagggattaacttcttcaaagttattcttaaaagggtaatttctctcaaagttactgggttatctgcggcgttagtaaaattcctccggcgtttcaacatgctcttgaggcgttctaagtcctctattataagattaagtgccctaaacactacagcagccagcgccagcaaagtcgtcaaaaacttaaaagtcttaaagtctctcctctaacttccggggcgagccctctcctcgcctctcctttgaaatttaaacatcgccacatccgggttctaagtagtaaacttcgtaaccctggcccgagccaaattgctcctatcggtccgagctgtcaacaacgagcctccaaca

SEQ ID NO: 38374 - DNA, 493 bp, Neisseria meningitidis
tagggaaatacgaaaattccttccggtgaaaaatccggggcttgcaggggcttgaaagcttcttcagcctcctcctaagctcggttcttttggtctctctttaagttcttgcttctcttgttattagtatctctatcatcccggtccggtttcaactctctaatatcatatctttgggcttggtcacggtgggggttatggttcttaatatcgtgggtcaactggttgcttaggctgcattgggggccagctctatcggaagtagtcgggctccagatcctgcttaagtcctctaaatccgcctcaccgtggccggtactcgggctacgcttcttaaaatggctactctccaaagaagcttcgtcttccgcggcgcgggcgttagatataaaagagccttctgcctggtcttcttcagcacttacttctcggccggtactgcggttaatatagactccgtcttcatgggcctctcctacaaagttatctttgc

SEQ ID NO: 38375 - DNA, 437 bp, Neisseria meningitidis
gtccatcccaaaaggtggtcttgttctttcttactagtagagtccgtacattcgagggcagcctggtcgacctagaattgagcttggcctgcttccatcaatatctctgtcagcgtcccagcagctctttgggtactttcaaaaacagcttcagaggcctcctccgccgcgctcctagtagatctatagaccgcggcctctgcaacggctctcatcgcttccgtactaataaggtctttatagtcttcagcgtgggccgctgcttctgccaacacttctacctaatctttagttcgttcgtccgaagctgggtcgttttcactaaattcctagttcttactcttgctgttcttctagtcatctataccgatcatatctcttttagatggtgcactgctggctctcgttaagcgggtcctcctctcgaaggggtaagt

SEQ ID NO: 38376 - DNA, 338 bp, Neisseria meningitidis
aagttaaaagtggtaataattggccggtgcttaaaagagttaatacgggaagttctaatctatccatattcgttcttgtagtaaatactccactgttccaagccaaacttacatcggttgtaccggttcttatattttgggtatctacagagcttaagcttgtggtagcccaaccactccctaaaattagtggttcctactcatggggaagccgtccgaaaattggcgttcttctcgcctgcattactaaaaacattatggcgcctcctccggtggttaatatgggtaataaatgcggcctcctggccataggtagatgggttctaccagcaagtaca

SEQ ID NO: 38377 - DNA, 411 bp, Neisseria meningitidis
ttcatacgcagattcgcggtcctaaatgtcgcggctctactcgccaaagcggtctgccaggctaataccctgggacaacccagatacttgatcggtaactaacgattctttaagctacccctaggcttgctgggcggaatcttgctagtcatctaactccggggcaaatttacggctctcctatccagcctcctaatcgagttatttcccttgctattaagtatgatgatagtagaggcacatagtcgcgtagttgggctggggaatacgagtgtaaaagaaaaatcagatgggggcgggtggggggaggggcaagcatgctcggggcagccggggaacaaaaccttcgtgcaaacgttagagtgcttcaggtaggtcaagtaaagcgggtacatccttgtaagtcggtcg

SEQ ID NO: 38378 - DNA, 499 bp, Neisseria meningitidis
  misc_feature (441)..(441): N is any nucleotide
aatgtaaaaaattccaggtttctgcaaaataccaagttccacgtgtacccggcacaaaaattcgggggtttcagaacgggttcgattcatacattgacaggtttcttgctctcccaagcatcagagggtacggggcgcgggggcagggggggcgggggctcccaagcatcagaaagcatcagagaacgagggggaggggaagttcttagaggagacgccaggaataaaaattacgatcctcggcttgtcttggactgtaaacacaatcaggtgtgaaccgctgcaactattaacgcaagtccggttcgatgagggctatgcgtgctcctggtcgtcttggcgttgcagggggcggaagttatgagaatctatttccttaaatactagaaacctatccctactttcagggccaggcattgagggttttcatatttgtcttcntactgtcggtcttaacctaacagatcttggccgatttgggcttgctctcgtcgaactt

SEQ ID NO: 38379 - DNA, 578 bp, Neisseria meningitidis
aaaatgggcagtgtgggcttcgggattatcagcctagtcgtggggaaggtcctacgattggccaaatccttggcgcgctgcagtcgagggcaaaaccgctactactagggtcctaccccgtaccgtcggcatcctcatcatggtcagcgtcgccctgggggtaagggcatctaagctcacctccttcagctccttcaaattcggaagtctgatgggaagctgtagcgagagatgttaactgcgcaaatcaaagggtaagattgcgaggcgaggtgcaaagaaacggataggttatgaggatagtgaatgatggcttctggagggcagagacagcaaggggatgcgggctatacagggttaaaatggggattagtaagagggcaagggaaaaggggaagcagcaggggcagcaggcttaattgctggcgctcgaacgactaaagagttaagaggggtaggattgggggcgtaaagaacgggcacgggaacatggctgcgagaacatacagaactcgccagcggggggcatggaagaagagggtgcgccagaatgggctgcggggttgacggcgtgttat

SEQ ID NO: 38380 - DNA, 504 bp, Neisseria meningitidis
gtccgattttcccccaaaacgacggcctcagggtctacctggtcgttaacgtgggcctcacgagtagtctcttttgcggcttcactcacctggtcagcagcgtctcctctcctagacgggtcagtacctccgttagactcctggtgatggtcgtcacagatctggctcatcgcttcagcaccagcctggccctaagggtcgtcgcggtccttgcctgcaataaagttagtcttatttaagtcctaccgcgtcgcttcgtcctcagcattaccagggtacatccttttcttattagcgtcagcttcattatcttcaatatctcctcgggcctcctcctcatcaacctcggctttccattccgcaggggagtcatggcccccagccgggttcgcttcgacctcaccctcctaattcttgctctcttcttcatccgcaacatgggccggatcttcctcatcgagctcctcctaacgatcagcgtcggctcggtcttggggccgcgtc

SEQ ID NO: 38381 - DNA, 396 bp, Neisseria meningitidis
cctgaaagatgtagtagtcattcagacgcaattacgattcgcacccaaacctcaaaacaattttcccaccccacgcaaatacaattgcaaattgcagctagataaatacgcccactctttgacgccgcgcatgctcgattggggcgagaagcccgtaatcatggataggtacgactcactggaattcaagaccccacctcgacccaaattcacgtggaagaccctcagcacggctgcccgcgacatttcaaattcacgcagtgagttagccttaccggcaaccgcttcgaataccgatgccaccattcaatttatctagcggctaaaagctccccagcactgcgccagaccccgcaaacctgaaataaatgtccacagactgccggtgttttcaaa

SEQ ID NO: 38382 - DNA, 412 bp, Neisseria meningitidis
gggcgctccaggtaaaagcaaatttccggggggtccatagagggggtgcattcgaggaactaggcttgagtttctgggcgccgagacgccaggaataaaaagtaccataacctcatcaacttctacatacgatcctaacctcacctaatctgcgatgccgggggcggaagttatgagagatcctacccacctccctgccgggcgggcctgcctcctcctcagcgctcccggcgcctgctgctctctttgcatgcttaaatgcttttaatactcggagctcctgggcgggaggatatgcggggggcttctacgaggccgcggtccctcctagcaggtcagcgaggccgagtttcgttgtcgtaagtgcagcagcggcctccgcggtcctcctacttgcgggcttccctacatc

SEQ ID NO: 38383 - DNA, 305 bp, Neisseria meningitidis
ggcttgggctgatagagggtgtgcaatgcgccgagtgctgcataacaggctggaatgctgttgacaatgacgcggaaaccgtaaatatccataacctcggcaaagcgcagctttttcgccatcattttctgatggatgccgtacaggtttttttccctgcctttgattttggcctctatattcgcgcctaccagccgctggccgaatgcgcgcaagactttgccgacaacgtactgccggttcttccggctcttgtacatcgctctttttaaagtctcgtaacggatgggatgcaagttatggaa

SEQ ID NO: 38384 - DNA, 415 bp, Neisseria meningitidis
tccctgggcctatcgtacctaggcgaggcctccgctgcagggggtgcggcaaacagaaaaaatctcttaatcttgcattttgggtttgcggtacatcctagagcttcgtgcaactgggggccactaaattctaagcattcgtttttagaggttctctccttttcgtagcctacataggcttcttggttcttgcattcaacaccaaaactaatcttgctgtcagtttcttcgacctcctagtagttgtggttcttctaatggttaaaatagtcaataatgtaaaatatgtattcttcaaagtaaactttgctctatatttcaatgtaggagtcttcgtcagtatcaaactcctacccgctaatcgggtagtcaaactggtatttcttgctttctaagcacgatctgtcctcacagg

SEQ ID NO: 38385 - DNA, 389 bp, Neisseria meningitidis
aaactacttaattagcaaagtagtctgtaccctcaacctgatattactaactaaaatgcgtactatctacgtcagggctgcaaaactatgattcttctgattttgcgaaaacaccgagaaaagttctgggtatttgtactttctctttgatctccctggggggcgtacgggttcatgggctcccacgcaggctttctttacgtctcttaacttgcaggggcaggggttaatgttcttatagacttattaaatgtactcctcgcggttaatactcgccttcgtggcttcgtgggtcctccaggtccctcgattcctctcattagtaagctactacctccccgtcctagcatgcttggggtcataattggaagggttcgacttcaacctct

SEQ ID NO: 38386 - DNA, 446 bp, Neisseria meningitidis
gtccgattccaaagggattctatcttgcttagaatccgctccgtcgcgatattcatcaacttagctttctataccactgctgtgagatacttgagtttcgtcctactcctctatgcttggagggttatcctcactcgttacattttcgcttccaagagcaaagtatccctaagttgcttactaggcagggggttcacctcctacctaaaaggatcagcaaaacgggtaactgcgagtacccgaaaaatcaaagttcttttcgtacccggggaattcttcctaatcattttaatcctacctgcattctcgattaaggtctctgggggttctgtaacttgggccaagatcctatctgggagatcctccgaggtcatgagcgttctaatccatcctcactctacctcaaagcctacgggacaatttcaaaatttcaggatttggagggg

SEQ ID NO: 38387 - DNA, 444 bp, Neisseria meningitidis
tttcttgcgtttgtcgtcggcttcttcttgctattagtcgtcaactttgtaattgtaattgtcctgatgccagatgatgcattctttggggtcgtgcttaatttaatgatattcttattaaaacttctcgttcttactctagtcttcctattcgatgtcctcgaagtcgtcctgtctgtcgttttgatggtattttcgtgcgtcaaattaaatgtgccaggcgtagtcttacgattatttgtgggggtagcatttctattgataaagatacgggtgttattggtggtaggattaggtaactttgcattacttgtgtttgtctaccgggccatcgagatcttcatagctttcgatctagtagtcatattaggagtcctctagtttggcttgccctcctacgtactgattgcgccttacatgccaaagattgtatctgtcaatcta

SEQ ID NO: 38388 - DNA, 467 bp, Neisseria meningitidis
gggtcttagttcggggttattaacgtggtcccagtcctcattaaaacgggctccagccctactatctttgctacgatcgtcggggtagtcattataaaaagtggcgtccgagccgtccctacctgcgtcaactcctctacagactctactattatggtatacctcatagtcctctccagctgcattaatgtcaacgttagaagtctattcatggccggcgtggtcgaccataggcttctgggcatggccctctcggtggttgtagtctcccgggcgactctggtcgaaattatggccgctcctaaagtcgtgcttacggttcttaaggtcgttctcgttaaagtagtcattctgcttaataaggtcgtgggcgttagtcatgtcagtactcgggtctctattctcgtccagatggttactaagatggtcttcgtcgtggttccgggcattacaagttacatcagagg

SEQ ID NO: 38389 - DNA, 420 bp, Neisseria meningitidis
  misc_feature (409)..(409): N is any nucleotide
atccacctccctcacttctgcctcagccggggcctaaatgtcactctcgtccctcagggtagctccatctacttcgcatgttcaattttccccatctgccttcctctaggccgtttcgcgagctttaaattcacgggccccgtcttgaactccataaaaattccttttaaaccggcgttcccttcctcctgagccgggggatcttcgtcatctcggtgggtgcgagccagggccccagcgattaaatacccggagacctgggtctattcaggggagcggtcttgacaggccgggctcgtagtctttcattgatgctaatcccagaaattggccgtacgggcttcgtccgcgacaccaatacctcggctagcaccagcggaagcaacatagcggcattggcgctcatccnccacatagtcc

SEQ ID NO: 38390 - DNA, 469 bp, Neisseria meningitidis
cctcctctcctcggcggggcgtacttactttatgggcgtgaggcttaggaacaaaggccaacaacactggcttcgtgtgggcgggcattccactacgaatcagaggaggatcattcacctcccccaatcgagtcggctatacctctcgaaccgaggccaacacctccactggagtacctagggcctaaagcaacaataaaatcactgccacccgctcggtaaatgtccctgcagggggatccggctcttcgattgctgcttcaaatgcaggcgggtcggctcttcgatgctattcaaaagcttgggcagcggccaacacaaggatatctagatgggcattcacgtctgtaaatctccccatcggcagctcaggagtcggcttcaattcgggtaacacttccctaggcggattcaatttggcgagcatcaattcgggggtcgcaggcgtttcaaccctaggtagggcacc

SEQ ID NO: 38391 - DNA, 380 bp, Neisseria meningitidis
ctgggcaggtgcaaaagatcatgctatcctcggcccaactgccagcggcaatactttcaatagacatacgcttaacatcattaggaaacttcagcttcttaagattatttaacttgctgctaattagatccgtactacgctctttcgtacgttcctaataagcttcattactcgagaacgtacacttaaatttgcaatagaaatcatccatactataaatctttctcttggctttcttgggggcgtcttcattataagatgccaaataagtcctaataccccagatagatacctccgaaaatgtaactttaaattactcacaaaaaatcttaaaacaggcctcggcactcgagtttaacatactggcaaatcctgcgtct

SEQ ID NO: 38392 - DNA, 234 bp, Neisseria meningitidis
aacagagagggttacacacatcctggctaagtatacacctaggtcggttcgggataagagctcagcatcgatgattgccgctaagaggatgacttaaaggattaaagctgaagaagctatgagaattactgacggacgaagaggtaggatcgggtcacagagtgggtgtaggtgggctacaaatgaaaggactaattagagggttaaaggtgctgaatctccagcactcgctct

SEQ ID NO: 38393 - DNA, 495 bp, Neisseria meningitidis
  misc_feature (465)..(465): N is any nucleotide
tcttctgggtctccgaggccaaccgaaaggtcagacccgcctgcttgggcgttctcgaggttccaagccgccatatggccatcccaacccggattcgggtctctcccctaattggcagattcttggtccctactttccgtaccctcagggtcgtaaacttgggcatatggctccgaagtactgcggtgggggtatggggcggcagcagatctacctgcgagctcggggttacttacttgggcctcggggtctctattacgatcttatccgtgggtaaaagagtcattgtcattaggggctctcgccataaattccttaccaacctaagcagaatgaatcttaatattctcttcgaattgcttatctctccgtgcactacttcggggggaagcgtgggggtacaagaggtcgcggttactctctgggtccgtcgagaatccaggaagttctctccagactttaggngcgttagaagtgtagtctatctcgtcagat

SEQ ID NO: 38394 - DNA, 399 bp, Neisseria meningitidis
gggtcttcgtccgtaatataggcttccgtcccggccgtccctctcaatactaaagtctcttcaggggctttctgggcacggtccctaccggggttacgctcgtaaacgttatctccgagggcaacaacttcctggtcttggtcgcggtcatcggggtcaggggccctggcatccaaatcaacgctgctttggtcatagctatcgtcctagacttcagcgaggtccctctcactcctaataaaagcctgggggtgctccagcgcttcgtgcaaaccggcaagggcttcttcaacaccggcaaaacagacaaaaatctcggggctcaattcggccgtactctcagaggcgtcctccgtacaggttactgcgaggtctccggcgacaacctccgtactctcg

SEQ ID NO: 38395 - DNA, 407 bp, Neisseria meningitidis
tgggtttcagatctggctcttcgactggatcttggtcggctgcctaaacttctgcggcacctctatcttttacgggggagttaacttgggcactaccgtggccctagtcatccggggccgcagcagtctcttcggccgtctcttcagattcctacacctccaatttctcttgggggcgatccaaatcatgggaattaaactcccagtcataagaaagtgcttggccgccgaaaccagggcctgcgtccaagacctcggcgttattggcagcgtcatacacggggcatttagcttctctactcgtaccaaggcccatcgcttcggcttcgtcttcaaagtcagccaccctgtggtggggaacacggtctctagagtccggctccgctgggtcgtgggggcggctactc

SEQ ID NO: 38396 - DNA, 359 bp, Neisseria meningitidis
tgatcggattctgtaccgcttgtgagtacctccaaggccctggccgtcaatgtggtaaaaaagatcagcgttcgagctcttgcggttatccatctcctcctactcgaccgtctcctcctcctttggtggattaacttaggtgtctttaattcctccctactcgcctcccataaagttctagtattcaataacctcaacgtaggattcttaaagatcttcattttcctaagctttaatctaatggccaaattggccggcttctcatgggccaacttactagttgcttccagaaaaaacatttgcagcttaaatgcagctacctaggcgtccatcgagtcggtaaagatgattctcaatgc

SEQ ID NO: 38397 - DNA, 435 bp, Neisseria meningitidis
gctggttgcggatggtggggattatgcaaattaagcggtattagttacgctcatacaatgagtactaggaagcatccgaatcagcggcggccggaggcttgctggtgtggcgcctcccgggggaaataacacagaattactattgattttgaaaacgcgagtaggctaaatagaagcaggggccatagaggaagatggttcgttgcaggggtgcggttgacaaaggggtcgaggggaacataaaaggtaggagaactagtggtagtgggcaacaagaaaggcaaaagtacgggggtaaccaaacagttgtgggtaagggtacagatactgatggtcaggggggccaggggcatagtaaatactgcaggtaaaaggctgccaacagaatgatggcgtacgcgggtagaactggggacacaatgaagtaacgtactc

SEQ ID NO: 38398 - DNA, 439 bp, Neisseria meningitidis
  misc_feature (17)..(17): N is any nucleotide
gcttctttgtaagtacnatggttttcggaaccggtagcttcttcggcactaatactcgctgcgtccgctcgggcccatcagacgctaccggcacgctcttcggcgaatccgaggtcccttccttcgagatcctcctagggctcagagcctcccggggggtgagcctgctggtaggccggggctgcgaatgtcctctcctgggctttcgggctctcggggtatttaacgagttcttcaaccgaagtaccgtcccctccctaggggtcctggccctcatggcggtcctccttgcggcttgcggcggcttcagaaaggcttactggcggcacgggggtagagggaatcccaaaaaggtctctcccggcttcttcccgggcacgagcaacgacgtccgttcatccggctccgctcccggcagcgaggtcgaaattcttctcgg

SEQ ID NO: 38399 - DNA, 454 bp, Neisseria meningitidis
tcaactccggacaaagctacacgctccagctcctaagtacccccacgagcgcgggtagtcgagggttgggggttgggggccggcaaatccgacaagtacatgggaggtcccaccccgcgaatttgggttaaagtaccctaatatagaccctccgctgggagcgcgtcgcaaatagtaggcggttggagtccgggcgggagtacctggtccatcccctcctctctcttctctttcagcggctcttctcgcttccaatcttcgagcttcgtgcaaacttgcgttgggtacatcctaggctcgtagggtagtttggggggcactaccgtggtagaattcttcgcaggcctaatagggcgagaattgctggggggtactgtggcaaccctcctggtcctatcttcgttctgctcctacgacaacggcattcctcgcgtgggcgtccctctcctggtcg

SEQ ID NO: 38400 - DNA, 266 bp, Neisseria meningitidis
aacctctaggtacgtccgacattaaactccaggtctgcaggccgcgcagtgtgaggtgtagggcggcggtaggggccggagcggtgaagcaagtgagagctacccctcctccgggcgtaagagtggtgcgctgctagtagtaaattcgtcaggccaaaacgctgctttgcttctgctatgggggtacatcattggaaattcgggtgaggaaaagactctaggttatggggtacatcctagttggagcgggtttcattaagttcttt

SEQ ID NO: 38401 - DNA, 337 bp, Neisseria meningitidis
cctacatctcacggcttcaggcgggccgtcagcctcaaaccggtgggggttaataacttccggggccgcttgctcctttgctgctgggttcttggttgcttctaatgtaggatcttctggggcatcctacctcctagggagtgcgctgggcaacctcgacaaaactgctgctataacgggtgctattcatagcatctctagctgtcgaagcctcctaagtcctagtcctagcatgcggggccgcgatccaagtcggcttcgtagtcgtaaatgtcatcatggacctagctgctgcagctcttcattataaattggggtctctacgggcccctaaagc

SEQ ID NO: 38402 - DNA, 460 bp, Neisseria meningitidis
ttaaaaactttcgcacctaactgtaaattctaacaaagctacctctcgctgggattagggttactggacctcctagtcctcctatacctggtatcttaaggcgcaatctgtttcaacgtcttagtggccctcgcgctaaagtttaaagtaaattgcgggccaatcctaaacacgggcttttctcttgcagcgctttcggcacttgcgttggtcattattcgcgtagtcatccgctccttccgagctctggtattcgaggtggcctcaactgcggcaaacatggttcttctaggattggagaaaagaaaatagtttgtgtaactacgtgcagaagcgggccaggctggcacaggcagcacgaagccgcggaaaggtaattgggaaaggaagaatggagcccaaagggtggagagacacctaggacggcttaataacagcactaaaagaagccatacggaaa

SEQ ID NO: 38403 - DNA, 399 bp, Neisseria meningitidis
tttccgtcgaacgtagcttctttcttgcattcgctcagctattagaggccaaatgcatacctcgagtccgggccctagaggcacaggtccgagtcatcgctactggggtcctggtaatgggatttcttgcttcgggcttcgtcctccggggccgtactataatcggcgggggaaaaacaattgcgggcggggtccgagccgaaatcctggtcgtctgcttcatggtcgataataattgcttggtggccaacaatatcacagctcctcaagtaaaagccagcgtctgctgggttccaaatgcgggtctctttggtctctgtaaagcggtgggtaacgagtttgcggtcgtaaattcttgcttcgttaacttcgttaggcgcgaggctccggtcgtcccag

SEQ ID NO: 38404 - DNA, 208 bp, Neisseria meningitidis
ggcaaagtagccgctctattcgcctgcttcacaaatgcggctacttcggtcagcttcgtgcaatcaggcgttcgagccggggatacttaggttactatcttcattctcgtggtcacgttccctcgcgtcgataccaaaattactcgcgtgctcttcgtctgcagcctcctggtggtcatagcatctcgccgtcagcccctcgggggca

SEQ ID NO: 38405 - DNA, 480 bp, Neisseria meningitidis
tccgtttcctggcggtagcaaaactttatctgatcccgggtgaggtgtgttgctgaaccgggggcttcgaccgtccagatcaagagttcattgatagggtaaagggatagtgtggttaagggtctaaatggccgcgttaatgtgggtatctttgcgggcttcaaaggcagccgtacgtccctccaggtcttgggagtgctcctagtcagaagtatcttccgcttcaagggcctcgcctccatcggggcgttcagatccaaattgctcgaccgggcccctgcgggcgacgtcgtcagcaggggagtgggccagctcctccgggcctctcgcggcttcgaatgcgtcgacctacctgggggcatccataccgacgctaagatggtcccgcccagtgtggtcatcaactcccacatcagcttcaaggcccgggcgttcgctactagctcggcggctcttagccgcagcgacacctcgggctcc

SEQ ID NO: 38406 - DNA, 106 bp, Neisseria meningitidis
atcgcactccggggagttaggattctagtaattaggttaaccaaggactacattcgtacaattataggaatcctaggcacaaggggtccaagtacctaaaatctcg

SEQ ID NO: 38407 - DNA, 113 bp, Neisseria meningitidis
agccagccaggtcgtaggtttctctacctcccaagtgaccgtgcgtacgctccaaatggagtccagaaaatccgggtgccactaggaggtcgatgccaggtttatgggtcgcc

SEQ ID NO: 38408 - DNA, 473 bp, Neisseria meningitidis
gcttcgggattctcttgagggacaactccctccataaaatcttgcttcttcggcttccatatacttgtcctcaagatattctatgtcggcttcttcctctaggcaaggggcttcatctccgtaaatgtcgctcttgctctcttcaatgcagctacgttcttcgattctaacctcgccctctaagcctcctcaggtgtcctggccaacagcactaccggaaacttagggcgcttcaacttcattaaactcaacgccgtcaacttcgtaatggtaatgtatttccataaagtcgcaggctacctaatcttcttcttcgtccatctcttagcctgcttcttaaacaacttccgcttaaatctctttgcttctgctttcgcgttcgattggtttaggctacttgcagcaaatttcatcgtcataaatggcttcaactttgcaaaattcggcaaagtaactacttctaaagttctcgg

SEQ ID NO: 38409 - DNA, 375 bp, Neisseria meningitidis
ccggctaccaaaacccgggcaattcgctagttctggtcagcgtgcgcagccgcggggttggcaggggcggcggcctaggaggcggcaggagtcgtttgagctgccgtccctacggtaataagggcctagtctcttgcttttaaggaagtccggggagctacaatatctgctgcttcgccggccaaaaagataagtcctccagagcgccaaagtcagtacctagtgaggaggctcgcctggtacctctagatcccacacggcactaatctctggaacctcgccgggtttcggggcagcacctaccctcctaagaggcgtactacgagtcctaattgctgctgctggtttggctgctgggatgagggttgctgccag

SEQ ID NO: 38410 - DNA, 417 bp, Neisseria meningitidis
cgcggctcttaatgcttccatagtcgggcttcacctcggcgggggcggtatgaacattaaacttgcttgcgtagcgattcttctcttcttcagggccaacttgggtacatcctaggccgtcagtacttacttcctcctcacgggcattcaattcgtccctgctccagactctcctagagtaccagcttctgctaataaccgcctcctgggggtgctctgcatcatccccgggggaaacaaatgcttcataggcttaactatcggaccaggaccaacgggatgcggctccaggctatatatgctagtccaaatagtgggtcttcgtcccatttgctttctctgtacggtcctaatcctccttcttaaagtcttcgaatttaaacgtcctataaaagctcgggggaagctaaagatcat

SEQ ID NO: 38411 - DNA, 325 bp, Neisseria meningitidis
gaggtaggtaaattcctctaatatagggttagtatcttggagggcacttgcgttgagattcagcttctggtccctaaacgttcaatatctcgtaagattcttcgaggcctgtaccagggtcctaaaatttctacgctccaagcccctcgaaatcttcaaagtaaaccgggtatctgcgtttgttatctgcttcttcttaaacctttctaatgccaactctaatatactctccctagtaaaggacctgattctgccgaattcttccagagcttcaaaccccgtgcatcagcttattcgctctgcgtaaatttgggggtgcttcttc

SEQ ID NO: 38412 - DNA, 156 bp, Neisseria meningitidis
aagatcttcatctttcaatagttctcgggctcactcctacagcctcggccataggtaaattcaagtacctctccacgctccatgcattcgttgtcatgcttcaatataacaaattgattctagttctctttcttagattcgatgtctacctccacc

SEQ ID NO: 38413 - DNA, 483 bp, Neisseria meningitidis
tgattgcaaaaattctggctttagggttggcaggccaaaaagtccctgggggtaagctctccttccgaaagagagtcgaagctaccggcttcttaactgggagtgctttctcgagtttaaggctgcgcttcatgacacgggcctttcagaattagggcctccaggcgttgcaaatagcgttgatagtacttttaacagaaactgcagccttgccgggaaaggcttactgtaaagtcggctcttaagattagttttctgtcctacataaatgtagggtattcgtcaacttatcgatccgcgccgcgttcttcagacttacgggcgtggctcagcggactccccggggcggttaggcgctagcaatccagcgcgtagacctaaagactgcgggattcagggcaaaaccacgagggatagtacttcagcttcgttaaaggggtagatcgcatcgcttggtcttaaactggtggtactctctctaca

SEQ ID NO: 38414 - DNA, 358 bp, Neisseria meningitidis
taccaggagggtaatagtactggaaccccagcataagcccatagagggaggtccaaacttcgcagggttcttgggtacatcctgcccatcctaagcatgcataattgaagatacagactaatcttcagaggcatgcggagtcctcgggggcggcttctggatcctagtagcaccaagatacaaaatcttaaaaactctctgcagtagccttcaatcgaataagcttctttggtaacaacttagaattagacgaaatccctgcctaaaaatacatccagctagatgtcttattgagatagtccagattttccataacaacaaacattcgcaacttagatgcatacggggaaattactct

SEQ ID NO: 38415 - DNA, 224 bp, Neisseria meningitidis
aaggagtggtggtacttgccgggatgtcaggaggttaagcacgaagaagtcttccaggggtgttggggggaagagacgaaaaggtagcaaaagagccaggggtaccaagagcgtggggagtggtagaacttgtcgaggtaccagacctacagcctagggggggaattttcgaacgaactaagtgggtgtttagacgtcgctggaaatgatatctagtggggtcc

SEQ ID NO: 38416 - DNA, 435 bp, Neisseria meningitidis
tttcttccgggctctcctcctgactaaagtagcattcctcacgctgggcccaagcctcctcctggccagccctcgtcccggggtcgaattggctctccgtacgctccaaatcacggttcgatttaaattgaaacaccaaaagccaggatgtagaaggcgacgtgggtgggtacattggagcgtcgtgcaaatcccaaattcagaccatccccaaagagacgccaggaataaaaagtaccataacctcctcacttctacatacgatacagacgatccaattcaggtatggccgctggtactattggacacaagtcggtgtgggcactgaacctcacctaatcttcgatgccgggggcggaagttatgagaaatgctttcttgcgcacgcctccactacccaagtgcgcgctccaggagcttagaaaatccgcgttc

SEQ ID NO: 38417 - DNA, 359 bp, Neisseria meningitidis
aaattctataggtaaacttatacaaaggctccggaagtaagttctagtaggtgtggttcctacaaacgagttcatagtattcctaatagtattctaatacataatcttaaacgaaagggcccggataaaaatcctcagcaccgggctcgctctgtccatgagattccggatcggattgctaatatacctaatggagttcagaacctgggaaatactgggccactcatatacaggaatcctaagcgcaagtgcaattacaagctcctaggccgtggccctaaactgctaggagccccctaaaggtaaccctaaccaaatacttcgcgtacttgaaattaatagactaaagcctagggcat

SEQ ID NO: 38418 - DNA, 386 bp, Neisseria meningitidis
cccgcggcgatctggggttcaactcggtacttatcaacctcctggccgtcctaattttcgttctcttcagaggactaattgctttcgcttgcttcaatctggttaaccctcgcaaccttcgtgacaaaaggggccgccgtcctcctacgggccctctccatcggggcaataaaattcgattctacctaggcctgggctgctttcataagctctcggtctacagcgattattaagtcccatcccctaactgccctactggctacctccaggatcatctctgccctcgcaaacttcaagctcgccaagggaggattcatagccgcgttcttgattctcagcttcagggccgcagggcttcgcttcctctctgcatcaggcttcacggc

SEQ ID NO: 38419 - DNA, 466 bp, Neisseria meningitidis
gtcgtgcgaaatccctgaatcctgctttactcctacgttcagcgttcaaagtacttgcgtccctaccatcgtcgtctccaactcctaaactgctctcccatccttgggctgctttcagatcttccgagttcatcctgtcagcaccggggctgctgcaagtgcctcctccaacggggctggcgctactaagtgcttctgcagcctggtcatctgcggggctacggctactactcgcaaggtccctcctagtacggtaaaaagtatcccctccgagggcaggggcctctctacctcacataccctccgtcttacgatctcctccgccgtcgcctctagccctgcttttcgaactctcaacgtcaacgggcttgctcctgtcctcctggttctgagtaccttctgggtagatactagggtagactcggctaaaatcgaggtggttcattacggggttccggtcattttt

SEQ ID NO: 38420 - DNA, 402 bp, Neisseria meningitidis
gatttagctcttcgttttctctgtaccaaaggtcacgagtaatgccgtcaagggtactctatcctccaggtctagggcaacgctaatgggtttgaatacaaaaaccttacgagctccgactagatccttgggttgctaacaaacaggcttagcacttatatctaatgcatttaacctcaatcagattatagttaagattgcgtttcttatgctattcgtattcaaagtcttaaatactggaattcttataaaactattagtacttctcaaagtacatcctattctatttaaccctactaagatactcttcaaaaactttactcctaaacttacatgagtaaatactcgaactcataatttgagaactgtcaggtctactgcaggtactatagtcatttttgg

SEQ ID NO: 38421 - DNA, 468 bp, Neisseria meningitidis
tagggcgagttctcgggagtccagggtgcggggggtatgagaagacttccgggcttcggctacctccggggagcccaaacctccagcagccgatcctcgggcagaagtcctagtactcccctcactccgggttaagatcctcgcaacctgggccaatggggctctctctaacagcgtcaaatctattggcgccgagtcaaaccgctccacagcctctctctggtccaaatcctggagctcacacatcaccgagagcttggcctccatggtcgctagttcagtcctaagagtcccctcgctaggcttactccgatcgggaaaatccagcccagctgccgtctttttgcggtcagctccatctggcttgtgcgtctctatcctggtcctcataagtgctgcatctcgctcctccagcgccggggcaaccaaactcctcctgccgctgcagccgctctcaaatcttctgca

SEQ ID NO: 38422 - DNA, 400 bp, Neisseria meningitidis
atttctgcgaatattcgtactgttcttaaatcttggagtccctccatctggcttcagtgctagtaaaagatctatgattgcttggattcgggtcctcataagtaatctcggagtcaatgctagatctcctacccccgcaaaatcttgcgtcaacgcgtcctccaaagttgtaaaatttggaaagtctctcttcaacaaattggccctcctcagggccgtcctcgccacaggattcgttttcttgagggtcatcagctttaatcttaccttattaaacagcttctctcgtgcctcccgggcaatcgaggctcttgctgtaatcaatttattcttcttctaagtcttgatccctgccataatcttgtccaacctatcgggcgtcgcgatcatggaacccctc

SEQ ID NO: 38423 - DNA, 290 bp, Neisseria meningitidis
tgcttgggcagggctgttcttatggccctgggcttcgtaaaactcgcgcccgcgccgtcgtcagggcgggcgttaaggtcgtaagtacttccgtaaaagccctaagtacggcgggcatctggttcatggctcgggtagcaattgaagctacatccgggggtgtcctacgttctagagttattacggccggctcctccggaattagactggttaatatggtggttatggtccgccctcagcgccgaccctagccgggctgaattggtgggtgcacgtagtagtgcgctcaa

SEQ ID NO: 38424 - DNA, 363 bp, Neisseria meningitidis
aaaaatgcggtaatggtggtggtgccatggtggccgtgctggtcattaattcgttgcatcacaaggggatggatattaataatgccattctgatcaattgggcagtaataatcgattacattatgacaaaatgagagcgccgtaggtattactcggcggtggtgctgcagccctagtccgggctgcagcgccccggaggttggttgcattaaatatcaccaacgccaacgcttcgtgcaacatttcagggttaaaagttaatgcattttggtctaaaaactaggccctaaagatcgtggttgcatccgtctttgcgggcgccgataacgaggctgccctccatgcattctctatgatattcgt

SEQ ID NO: 38425 - DNA, 467 bp, Neisseria meningitidis
tgggttccccaaggcttcactgctggcttgagagctacaatcaatgctgcagctagagcagcaaacaccaaaccagctgcgggttcagcaggaagtacccgcgtccatctccgctcctcagctttagtcctcgcagcagctatcaatatcaacaatatcattctcttagtctatcctgtaaacactgcattcataagggttaattcttacaacccctggctccaactgccatctcctgggatctctgcctcaaacaagccgccaccagggcaatcattataggtagggccaaaatcagaggggcgggctttctcgatgtcaggtggaacccagaccacgtccagagggttagcttcgtgcaaagatccggggttcgggtacatcctagggttcgcgggtactttactaaggtccctccaagctcctagatcccaagtcccggcaggggcgctgctagcctctccgca

SEQ ID NO: 38426 - DNA, 426 bp, Neisseria meningitidis
caggaaacgcacttgctaataaaaatctcaacaactccatcacggagatcaaagtaacaacaaaaaatgcatttaacctcatcaaggctaatttcctcgataaaaaagccgcaaacgggggagtcttagtaaatcttcgtgctaacttcctcataaaagcctcccttcttatccgaataaacctcgccgagtctctaggtgcttacgccaacatagcttggatagcctccatscttcgttccgacatagtcgatgcaatttaggccctcgattggtttcgagcaatagtccgtacaggggccaacggtatggcccggccctactaaaaccgagtcctcactcgagtcattcgagctgcaaacactaatctaaactacctcacggctctcacggtggcaatacatgtgataatcctactccgaacaa

SEQ ID NO: 38427 - DNA, 453 bp, Neisseria meningitidis
gcgtcaccttaggccgagttacggtcctaaccgacctgggaattggcctcactacctgtggcgtcgctccatccggggtcgtcacttacaatatcctacctcgcggctgtacatccctctccggcatcctaacggcgatttacgtgggaattccactcgtgggccgggcctatagatcttacagcgtcttcctggtaatcgtcgctgctaggaccatggggttgcttctagtaagcatggccatggccttcgtcctggtcagggtaaaccggggcggcgctcacttcgaggtggttcttctggctcttagtacgttcatcggccctatacgatttagccggcgtcccgtaaagctcttcgcggtctcctacaacgtcagccggctggccgaaatcttcctagactgctgcgtcccaagtatcctgggccgcgtggctctgggcttcgggggcg

SEQ ID NO: 38428 - DNA, 403 bp, Neisseria meningitidis
gcaaaaattggtaataaactcctccaaatagaggggccccagcttctggattttttgcgcccctactacttcctatccggcctatcctcgggtcctctactacgtttgctggcttcaacgcgggcttcttagtcctctcctcctaccgatccataaattccgttagcgcaaagagcttctcttccatcagcttaaaagttgctgccctaacctaattcgttgctttcaacataatcctaatcctcgccgaagccgcaggcatcatagtattcggggcagatatctctaaaaacaacttctcgcccctcaacgcctcaactcctgcctatatcaaagttctaagttctgtatctttagttactgggttcttcaatcctgcctcgccaaaggccctcccaactgc

SEQ ID NO: 38429 - DNA, 435 bp, Neisseria meningitidis
gttctaaattattgttaattgtataaatttgggaaaagttctgagaagtctttctaagggcagggaactaggtggatggcaaagcctataaaaaagttaagttcgtaaacctagcaatcattggtgcttgcgtaactaaaaacagggtaaatgcatcctgctcggggcctacctcgggcaacagatccgtccttctgccatatctctggatccggagtactaaagttcgatcttcaggcgtcactaaattccgggcgggcgttctgttagtcctcaccaaattcagcgccgtcctaaccaaagcgatattggtgttcaggtaaatcaggtgggcacgggcactggctcgttgcaaccgatcctggttgcttgctcgctccgccgtcaatataattggtgcgataagactttctaaaactgcgccgagagcccctt

SEQ ID NO: 38430 - DNA, 370 bp, Neisseria meningitidis
aatgtggctgaggctagctgctaggctatacgggcagggcatactggcgacaaagtaaggttcaggaggattaataagtcaggcacaaaagaaaaagaagggattgcaactgacaagtacggggccctagttaccggaggcgaggaggcaagaatggaaaaagagacacaaaggaattagctaaggtgttgatgtagcctgcaaaatttaacttcagattcaatgggttgttcagaactgccaatagtgcggaatcagcgttcctggccaacgccaacacctgcaaatgcttctcttgctcggactccctcgccgcaggcttcaacgcaaagttcggcaaaaatagttccagctacattcgggcaatcgg

SEQ ID NO: 38431 - DNA, 437 bp, Neisseria meningitidis
gctttgttgtgcaacttcattatgctatttagtactgctggctttcagatagaggcgctatgggtcttacagatctccttagacgttctattcacagacaatgcagccggtccagcaaaagattaacggaaacgaggtgcttacgacaaattgtctgtgttcaaaacatgtgctgttttagtaaagttctcaatccgcgactcctgcttcaggcataagggagtggccctaattaatcctcggggcggttaggcactggcaagcctccggctcgacaaaaatgctgcgggcttgaaaagaaagcccctcctgctcgttaaatgcctacgaagcaggggtagatcacagcgattgccaacaagagtcttcttcggggtggatccgctacctagatgggcctctagcttccgtttctcgggcgaacataatggcttcgt

SEQ ID NO: 38432 - DNA, 467 bp, Neisseria meningitidis
gtccgatttcgcgagtccggttcgatgagtgcgatgcgtgctcctggtcgtcttggcgttgcagggggcggaagttatgagatgattggtatagggtggaagaaaggggagcacgaattagatggtggccgtcgttaaaagtccgggtcgttggctgctcctaccggtccttagtccgggccctctcagggccaaagggttggagatcctacctattaatcctcctctccgcgggggttgctgcgggggcagagggatgagtggccgtctttgatttcggtactggcttcaaggggagagtccctctatccctccgaaaaagcttcgtcaggttggtacccggtgctcgttccctatctaagcctgggcccgtccctcgagccctcggcttcttgctgggaggggctgcgtcggggatactcgccgtcctccagcccgaggaaaggagcgtcgttatacggggatcc

SEQ ID NO: 38433 - DNA, 314 bp, Neisseria meningitidis
agggcaagggtttgacggagtgaccatacttttgaggtgggaatgaagggtgaactggcaaaggagcacattagagctgatgattagggagtaatgggggaggggcgggaggcccacgcgggggatgagcattgtagcgcaattgcggaagcaataaattacgggtaataagtttcacttaagcataccagggcaatagatccggatagggcaggggtaccctattaaaagccggagttttgagcctgagtggctatccgagatctaacataagcttataaaagcctgggttcatatcttaccctaccagctgg

SEQ ID NO: 38434 - DNA, 131 bp, Neisseria meningitidis
ttttgtgtttgcgcccgacacctcctaaattctaccgggctggccctcctaggggtaatcgctacctgctggggtcaggggggctactggtccggggactggtctacaaatgtgctgggtggtcaaactgt

SEQ ID NO: 38435 - DNA, 360 bp, Neisseria meningitidis
aaaactttggcgaaatcttgcggggcattggtcgtatcctaatcccagtcatcagagctcttatcaaaaaccggtgcttcgtagtggttatcggcagggtaaggcttcggtttctactcgggcacttcgctagtgtctcttttctcttaaatggtagagaagtcccaagtcttcttggtagactgcatcttctcagcatggtcttcgttcaagtcagggttgtctggcaactcgaattttaaattggcattcgcgtcgtcgttgctcgtgttagtggcctcagggtgctcgagaatgggcgtagcccgggatgttgcttgcgagaaagcctagctgcaagggaaactttgggggtaacct

SEQ ID NO: 38436 - DNA, 421 bp, Neisseria meningitidis
cgcgtcgtgcaaacacctccgtcgggcctccgtaggctgggttaggtcggccaacagtctaggcgcaactacgggcgtaaaaaagaggtctaatatctcttttgcttctctgccctcctccgtacccaactccagggctttcactgcttttgcaaaagtcgccctaccctaggaaacttcccgcacctccaaaggcttcttaagttcaccctcacaacgctccggggctcgcgcctccactccatgcttccgttcagattccaataagtatacacaaaaatcgtgcaagcctaagcaataaaggcaagggttggtgctgctggctccgcgctcgggttctgggggttcggcgcagctactaaaattacgatacctgtaagggtatactgggccagaacctcaaaaaataccaaagtcttgg

SEQ ID NO: 38437 - DNA, 451 bp, Neisseria meningitidis
tgcgaggcgtcttcgggcttcgcttgggcctactccgcggtccctgctgccgtccaacgggtggaaagcgtcgtagggattctcgcttccgtagcagccaatctcctgccatccgagggcttaaacaagagggaaattgcttctgcattcaacaccaaacttcgattggtaattgcagcaaattccaggttgctgcgtttaaagcttctcgcttcagatctctcgcctacaatagtttcaggcgtactgattgctgttgctctcctaaagctctggttgcttaaattaaaagtactagatcggagtttggaagtcactgctgcattcctcgaggcggtccctgccgtcttgcctaagatcctgccgtggccaggatctgccctccaggccgatgcattctcgggtgcagggtttgcattgggagtcagctccatatttaagattgctttca

SEQ ID NO: 38438 - DNA, 452 bp, Neisseria meningitidis
ccttaaagtcttccgataagctcctactggtctctaaagtctctacatccttaagctttctaacaggcctcctggggcttgcggtcctacgcacggttatgggcgtgggcaactcctgcgctacaggcgtcctgctgaaaacgaaagtttttagggggctccggcgattcgtgcggggccgagactgcttggctgcacttaaacgcggattcggattcacagggggagggatagtgggagacctcacagttaaacaggccagatttaaggtggtaacccgatctaaggtaggactggcccaaagcttcgttgcaggcacagttgcttagatatctacccgggccaagctcctcgtgcttctcggcagcagcggcgtcttcgggcaagttaaggtccttaaacttctcgacttcgcgggcctaaaacaattgtgcttagggccgcggcgtctt

SEQ ID NO: 38439 - DNA, 375 bp, Neisseria meningitidis
tatttagaacccgagagcgggccaaaaagcaggtgaaaatgggacctcgcttcatacgaaacgtgggcagggtacaacgtacagagactccgaaggcgcttaggcccgaatctgtgtgggacgcaaggggagaggaaggggcagaggttagacggtatgaaaaagttattaattatgacttagaaagaacggacgaggttgaaaataaatccggggaagttgcttgggggcaggctctggctggctcgtcggaacttaactctacttaggcagcaaaggaagaacaaacaagtcagggtaatcaagaagggtatcacggtggggccgaagaaagtaaaacaaggaaaaagcctaatattaagaaaaacgatacta

SEQ ID NO: 38440 - DNA, 370 bp, Neisseria meningitidis
aagatcatagttctttagaacaggtccgagtcaaatttcttctaagggccagcaaagtaaacggcttaagatgtaccaagtgggcggcaaaagcaagcaccgctgccaaccaacacaacccctgctctctcagagtcgaggctgtaatattcatcttctttgcgagcttccaaagcgtctgctggtctgggtacatcctagagtgcttctatcccaacttagtcaggtacctacccttaaagtcaaaaaacaccacgggcgtccggggtaattataataaacagcttaggggtggccaaacagccactggcccgcagcttcttagcaggagccaatggggcgcctaaaatagaactatggtatcaacaca

SEQ ID NO: 38441 - DNA, 477 bp, Neisseria meningitidis
gcctcttagattcttgctaccgtgcttcgttatccatctttcttaagaagagcccacattaaagtcagcgcgttcagggtggggatcgcctccagagttcgtcctgggctggtacgtgtgagaatccttgtagtcgtcaaacaactggtaagcgtgggattcttgttcgtggtacctctggttggttctagagatcttcgagacgggggcgaaggggtcggagacttcgcggtggggtgcttagatacggtcccaaaccagagctgcttcatccaggtcttgcgcgtcatcagattgattgtgattttctcgttgcgagacttgctggtaaggctaccgggcaccggcagtaaaggtggcgagctcgtagggcccgggccaaacgtgttccgagctacaggtcccccccccctaggcaggggcctagtttgcgtgcgaattctaatcgtagtttcattcctatacactagctggtgc

SEQ ID NO: 38442 - DNA, 447 bp, Neisseria meningitidis
ggggatatatgtagcaaggtagtaaagccaagtgcgcagccgtgaagagtgagtttagtaagaaataaaagagcaggagtggggactgggaatgcacagaaactagtgggaaaggggtgggtaagaaaattgaaagggctggccaagggatgggtgcgaaaacggagggcggcccaggttgtggtattgacgggaataaaggggttaaaaagtagggttctactggtggggcaaggggtgaggaaacggaggctggcgataagggttccagtaaaactcttagaagaagaggtagggagacttgtagtgaacctgggaaagggaggaaagaggcaacagaagaggttcggggtgggatagggcagggcagggcagagtaatacagagaaaagcatgggttaaagatggcgaaaagtgcaaatacggaacgcgtggctgggtgggact

SEQ ID NO: 38443 - DNA, 392 bp, Neisseria meningitidis
aaatctgagtctcaataaagtcaataggtacattggttgcttgtctacctgagcgtgggtggaaaacaatgtcaactcccctggaagccggagattgagggccaacatcaagacatctagtaacctagtccagagcgtcgtgcaactttcaggggtggatgtaaatattaagtagtatcattcaggcaaattaaggataaccaagtaggatcagctaagatactatatgcctaccataaattcataatgtttgtcgggttaagaagggtcccgggggctcttgcttctggaaggggagcttcgagcaaacgtagcttcaggcccggaggattcctcgcttggagcagagcctccgggtaccctcggttcctctctcgggtccgttgcaactt

SEQ ID NO: 38444 - DNA, 351 bp, Neisseria meningitidis
gaatcgaggactaccgaaacttttgtggttttcgttcctactcatttcagtcacttcaggcgctggttgcttctcattagagaatttggcttcatccaaagggtctgtaaattcctagacagctgcagcgacggtgtcttcacagtcattatgattatgggcttcgacttcgttaatgtcgttctagactggattcggtttcctctaagctgggtaattcggcttccgctacgccaagacaatatcttgggttaaagagtcttcttctgttccggtgctttcaaaacgttccgtcctatattcgtaattccggggggtaaatcgctggctagctcctgcaaattcgtccta

SEQ ID NO: 38445 - DNA, 390 bp, Neisseria meningitidis
  misc_feature (357)..(357): N is any nucleotide
attccgggcttcttcaggggattcagggtgctggtggggggccgccaagatgcgttctgccgacctggtccctgcgagcaaaaattcttctgtaactttaacctccaactacttcttcaactagccggggcaagagtgggagcttacagggtctggcggggtactaccggggggcagggcgtcctagtgcaaataatactcctcttcattaagttccggggcttcgggatctcaagttcagacttcgtgttgttgctaaacagattctgggctgtcggcatccagctagaagttcactgctggggtcactccggagactgcttattcatatgaaacttcgacttgattcgaatggcnctccaaataggggttgcgggcttgggaaatatc

SEQ ID NO: 38446 - DNA, 428 bp, Neisseria meningitidis
ctctttcggattgccttcagtccgagccctaaaaatggtaaccctcgcgattatagttgcaatcagcaaagggagtgtgggcaactgcctcctcaatcttgcttctatcacggtcatagtagtaaacctagtcagaagttgcaaggccaataatctgggttcggccaaagttactacggctctcatcaaagtcaaggccgctacctcctggttaatcacgggaagtgtcatcaaggttgtcttcctcaatgtatctttcgaggtggtcctgtgctcaggaataatggtccgaggtaccaaagttgtaaggtaggcaggcatgccctctttctcttcaaattctctcatctcattcgatcgagccgtcacttccatcacttcaacggggttccagggagtggtaaaagttaacttaagagccatttcaa

SEQ ID NO: 38447 - DNA, 435 bp, Neisseria meningitidis
gtctcctcatagtcagcttcgccgaatccctcgaccgggttccagtcgaggttggtatgggcaaaagtcgcaatctctgccgaagtattactaatcttctatttatagaaaatcttatcattatccgtgctcctataatcttgggtgtcctccgcggtcttaaattcagagatctaaatataaatcctacaagtcttcttatcattctctttcgagggctgaacaaatgggcaagtttcgacctcgacttgggtgctgttgtcggcattagcgtcttcattagtagtggaaatcctgctagtcttagagggcatcatatcgtgaatactctaagtagtactctcttcaatcataaacttcttactcatctagacttcaaattcaactgctttcacggtcctagtaaaagtagtataagaattctaagtactcgct

SEQ ID NO: 38448 - DNA, 432 bp, Neisseria meningitidis
gtccgatttatcattcttcccgagcaactttctttggaggttttcgtgagtccaatatctaattgctcctagggttcattaggtaccaaatgtggagccaggggaaaacatgtatcctcgggggtcttagtctctgccgcaggagcagtcctgccacaaaacagcggttttatgttcaactttcgttttctcttttaatacctactataataataccttcgaattctggttcttcaacttctctgtctctttctaatcttcaggattcgaatcattcatatccggtaacttcgtaggcagcaaaaaactcctcattgctcttcctgcatttgctgtaaagataaactaattcctcatcaaaagaaattcggtagttgcgggcctcatcctaaacaagatattgatcgtctttaagttcaatggggccatctc

SEQ ID NO: 38449 - DNA, 509 bp, Neisseria meningitidis
aattgtcacaggtgacaggtttatgggtcgcccaagcatccggtacggctaggttcataatattctaagtggcaaattttgttcttcggagaaacataaagtctcctataaaaaacttcgtgcaaagctgcggtcctccgggtacatcctagggctgtaaatgggagtacctcgaagcctctcgggtcttggtgttcttcataggtgtgctatactcgggctacatccgggtagacttgctaattctctttatagtctcccgcgacgcttactactcggtctagggggtattagtatgcctgggactcctaatcctaacggtctgcttgatgggtatggtgctgggacatattactaaactaaactctaaggtggtctttaaactaggtacagacttccttagggtggttcctctccgaagggtcctggtcctggctaaccatcaattcatccggggcgtcctctctaaacctgtcagcctcctccggattctggtctccctggtctcc

SEQ ID NO: 38450 - DNA, 455 bp, Neisseria meningitidis
aatccgtactcgtcgtcctaaaacttcgttctctcttatcgtcccctgcggctatatggtcattcttgttcataaaagtagtgttcctcagattggctcttaaaaacttcgtaatggccctcatctgggacatcctcgattccctagttatctggtctaagatcctcctcctctcgtgctgtttcgtaggtctccgtaaatacctacctccaggaaacgcggcaattagtatcctcaaatacctcagagcctccagggggtctttcagtatcttaggagccgacagattcttggcgtctaataccgtcaaagttgctctcccttccggatctgtggcgatactgtccctaagcgcctcccctgccgtcagcggcttcagcctaaaagttttcaaaaagcttgcaaatcctcgagtccctcaatgtccaggctcgggcactactcctaagtgccaa

SEQ ID NO: 38451 - DNA, 408 bp, Neisseria meningitidis
gtccgatttctccatggctggggttctgggcctgaacgagcgtgtgcggggaaacgcaggaggcagaggtgctagaggttcaatccatagtaagctagtattggcgatggttaaattcctatgcttaggaataaaccgagtccttagcttgcttctagcagcggcggtagttacgtcaggattgatcctaaaaagattggtctgccagacgaccctattggtggccggagcaagtgtgggtctgttaagagttaaatcgggttggctactgaggctttttctgggccgatgcttggttcgtcgggtggtttccggaactacgagggctctcgttaccctaagagccggcttagacaggggcttgcgtttccgcggccgtaaccgggcattgctattcagcgcccgtaa

SEQ ID NO: 38452 - DNA, 359 bp, Neisseria meningitidis
gtcgtactggatctactatttacccttggctagaagttccatgccgagcaaaagcatgagcaacaaagttttggccagctcggccaacagcaaaagcgagtgcaagtacggcatatagtacataaatacttgtaacataagatccaatggtagcaaaaagagcaaaagcaggagcaacaaagttttggccagctcggccaacagcaacagcgagttcaagtccggcatatagtacataaatacttgtaacataagatccaatggtagcaaaaacggcacatacgcacgggctaattaacacttctctacttctcactttaacttcttatgtactgctaactttaacttcttctctaact

SEQ ID NO: 38453 - DNA, 488 bp, Neisseria meningitidis
  misc_feature (467)..(467): N is any nucleotide
tcatcaattctacatcgataaagacgatccaattcaggtatggccgctggtactattggacacaagtcggtgtgggcactgaacctcacttaatcttcgatgccgggggcggaagttatgagatgggttccatgggttcctaactttgcttgcttctgcaaagagtgggtcctccaggcgctgttcttagagtcctggattcggcctcccctccgggcagcaacatcctataaagcttcgggcaaccatcggtacatcctagggcgctgcaggtctagtaacagggaggcgggcctgcttgtcagggccagcgtcagctccatctggggccgtagattaatcggaatcaccgacgttagcttttagggccgctccgtcagccgccgctgcaacgtcttcttataaatggtccggggtgttagtccctgggccgactacggcaagggggtcctgggcacgggcatccncctccggggcttcgctagccg

SEQ ID NO: 38454 - DNA, 351 bp, Neisseria meningitidis
  misc_feature (321)..(321): N is any nucleotide
aaagaataaccttcgtgcaaagtgcgggggtaatgggggtacatccttggctaatggcctagggtaggtcgatccggatcttctgaaacctcctgaattcgattgatcactgtgcagaaaaagcagggagccaactaactgcgacttgctagcaaattgaaaagttagctcgaaccgcgcgctggtactctctatctcggttagcagggatcctgtaagcttcgtgcaaaactgtataagggggtacatcctagggcggagctaacgaaagaggtacaggtgtgcgagatgcggtacatctcgctcgctgcaacatattgntgatctggctgctacaatgggtcccgaaaa

SEQ ID NO: 38455 - DNA, 267 bp, Neisseria meningitidis
tagaaccgattttgctggtgtcaagaagggtgattcatgggggcagctgggtaagacaaggtagcttccgacacacaagaagacctggattaaaacaccttattacgggaaggaagcccgacggaggataggtcttacacttcaggggagagctgccaagagttagatcggcgaagtcgaaactactgctatcacacaaaccacgatgcagaaaaagtagatttggatgtgtgatcgaggtggggaagggaagtgtagtggtggtag

SEQ ID NO: 38456 - DNA, 324 bp, Neisseria meningitidis
aaaacgaccagcttagggctataataactaaatgcgttataaaaatgaggtggtagcaaaaataagttataccgagctataaaacccaagttcttggattcatatttgaaaaaaaacaaagttgcagcagggggaaaagaaaaaaaacggatttatacaaaagggtgttgagtaagagaagtagtcggggaggagggaaaggggagaggggagggagaatttggtactaaaatccgatactaaactcgaaacctagtggggtaaaaaaggaaaaacggaaccaggcggaaataacgcgaaagtcccgacacggctccgtcagaa

SEQ ID NO: 38457 - DNA, 445 bp, Neisseria meningitidis
tccggggctgactagggtccgtggagggctctagcctgggggtcctcccgcgtacgctggtcagaaacctggtctctgccaacagctctgtcctcgagggcactactcctctcctatggggctttacgggcatagtcgacgccgtcacttcttatactactccactaaccctcatagtaagtagacaaaaagtggtcttcaccagcgagggctggggctgcaatcaacccctaactagccgtacattcggcttcagcctggtctctctggggcttgcggttggcggccgcctcctccccggggtgaatatggccatcgccggcaataaggtgggggttagatccgatactattacttccttttcattctctagaatcccagtcttccctagtactgctccagcccccaactcggtcgtaagcgaggtcggcagcagaggccatgt

SEQ ID NO: 38458 - DNA, 464 bp, Neisseria meningitidis
ggtttgccggctacctccgaggtcctctcctgccgcaataggtccgacccggtcggtatcttgggccgcagcaccgtcgttattaagatcttcaccgacctggcggtctcctctactaccactcccgtggcgttctctatagaggctatcctcggtctcttgcttaagaaattggctctcctcctggtggtcgacttccgtcgattcggcagggctttcctcaaaaataagttcctaagccggggccgggtcacctggctgggcaccggctctccagtcaacgacgtcgaggtcagcctcgacttcccctctaccagagccctcggggttaaattgggtagatgctccatcactctcagggccagcgtcaatcctacctgccgccacagattcggaccagacgaggtcgctcgccgtacattggtcccggtcaccaaaagtgccgcctgcgtgggcgtcctcaa

SEQ ID NO: 38459 - DNA, 480 bp, Neisseria meningitidis
cctatcttgggtagtcctagggttggtgttcttatctctataccgtccaagttctattcgagtttttgttctaagatcctgcgtcccgggctactcgggtggcggtaattctattgtcttcctctccagaagctccgccagagcctgtggcccaatatttggcaccagggggagtacagacggagtaacctcggcatttcttgtagcggtcctaattttgagtaactgcattcaagtgggctggagggtcgctcggggtagtgagaagttcaatagttcgggtactaaaaactctctttcttctcttgttgcaaatccgggatgggaaaatccaaggggagaggaaaaatctatgttctaaactaggggtttgctcttgcggtttacttcctacctctacaatcgaagtaacgggcaaggcaggggcttcgggtcctctccaacgaacatcctacttccctttaacgtttaaatctaaat

SEQ ID NO: 38460 - DNA, 292 bp, Neisseria meningitidis
ctcaaagatagaggaaaaatgtaagccacgcagcctagagggaccagacagagatgcaatcaacaaaagaaaggggcggtggggttgtagcggggacccacgcaggataaaagcaaagtctgcagcgcaggagagtccagctgcggtaactcattgcaaaagacaatggggggtaactgcttgggcgacggaatccacaaagggacataaagtttcaggctctatggggaatatagtgggtggaggctccagacaagatgaacgaagcagaaacagctgaggccgaggggaa

SEQ ID NO: 38461 - DNA, 167 bp, Neisseria meningitidis
ccgtccaactcgctcaatcaggctggcacacgtgatcgtctgcgtgctgcgctggaagcggccggtcatgcgcgacaattacaggttgagcatgggccggtgacggatagtcgcgcccgccgaatggccctggtaagaaaagccagccagttgctggccgaggacat

SEQ ID NO: 38462 - DNA, 403 bp, Neisseria meningitidis
aaatcgaaataaaccgtgttgtaacgggagaccgatgccgtcattcgcgcgcaggcgggaatctagaccattggacaccggcaatattcaaagattatctgaaagtccgagattctrgattcccactttcgtgggaatgacgggatgtaggttcgtgggaatgacgcggtgcaggtttccgtgcggatggattcgtcattcccgcgcaggcgggaatctagaccttagaacaacagcaatattcaaaggttagctgaagctttagagattctggattcccactttcgtgggaatgacgggatttgagattgcggcatttatcggaaaaaacagcaaccgctccgccgtcattcccgcgcaggcgggaatccagaccttgggataacagtaatattcaaagatt

SEQ ID NO: 38463 - DNA, 333 bp, Neisseria meningitidis
ccgagtccgtgccgtctgaagatgctttgggcaaatggtggaaaaccatagaggaatggcgttcccgagattgcttgtggtttgacaacggcagcgaaattatcaagccacaatatgtgattcagaagcttgccgagattaccggcaattcggcaatcatcacatcggatgtagggcagcatcaaatgtttgcggctcaatattatcccttcgaacgtccgcgccaatggctcaattccggcggtttgggtccgcaacacaggcgcctcttcaaactgcaggtcccgagccgcctgctgcatggctttttcgagtttggcgatttcgttaatc

SEQ ID NO: 38464 - DNA, 303 bp, Neisseria meningitidis
ccgtggtgtgactgcgtaccttttgtataatgggtcaacgacttacattcagtagcgagcttaaccgaataggggaggcgtagggaaaccgagtcttaatagggcgatgagttgctgggtgtagacccgaaaccgagtgatctatccatggccaggttgaaggtgccgtaacaggtactggaggaccgaacccacgcatgttgcaaaatgcggggatgagcacgatgggcgtgggtctgccttatgcgattggtgcaaaacttgccgccccggatcaagacgtattctgtatcaccggcgacg

SEQ ID NO: 38465 - DNA, 324 bp, Neisseria meningitidis
ccggtttcggttttttccgataaattcctgttgcgttgcgtttttggattcccgcttttgcgggaatgacggtcggtggggtttcggttttttccgataaagtcctgctgcgttgtgttgctggattcccgcctgcgcgggaatgacagccgccggacgggaaacgaccatacacaattattgacaaccccatttattgcgaaagtcagcctaggagaatcctctgtaaaaccggtctgagtcttcttttcccccgtactcaataatttatccgccgcctctttaccaccaaattcatttacaatttgtaaaaatcgtgtcgcc

SEQ ID NO: 38466 - DNA, 182 bp, Neisseria meningitidis
cgtccgaccaaccgttcaaaactttcattttacccgaccacgcaagccgccgaacaaaaaacaaggggctgtcctagataactaggacaaacttgattttactaattgttttaaaacggaccaggacttttaatttaatggtggttaaaaggcatttggaattctttaaaatcaagttaaaa

SEQ ID NO: 38467 - DNA, 326 bp, Neisseria meningitidis
cccgacaaatttttggcgcatggctttgatgcggccgcgcatttcatcgagttcggcaatccattgtgctttcaaatcatcatttttcaacatcgtcgcaatggtgttcgcaccgtgtgaagccgggttggaatacaaggtacggatgatggttttgacttggctgtgggcgcgggctgctgtttcttcatcttcggccaccaaagtgaacgcgccgacgcgctcgttgtacataccgaagtttttggaataagagctgtctatcagcaattctgtattgtgttttatgatcactcgcaagccgtttgcatcttcttccaaaccat

SEQ ID NO: 38468 - DNA, 251 bp, Neisseria meningitidis
cggttacgggcgcgaattgtccgcattcgggctgtacgagttcgtcaacgtcaacacctactgggagaaatgacacaccccgtgccgcttcatacggtatcgggtttgcgctagagccgattaacggcagtatttgtttacggcgttattgtatttccgaatcaactcatccttgttttttgcatttgaatttcccaccgccttcaggttcatttttgaaatccggcagttttcttctttggtctgccgtt

SEQ ID NO: 38469 - DNA, 522 bp, Neisseria meningitidis
ccgcaaatacaacccgattttcgactggtcggaacacgacgtgtgggcatacatcctcgccaacaatgtgccttacaacgatttgccacgtaaggatcccttaccgagaatgccgcaaaacacatcaatgactatctcgccaaacgcggcaaaggcttgggcgtacgcttgggtgtgaaaaccagcggctgctcggggatggcgtacaaccttgaatttgtcgacgaagccgatggcgacgacctgattttcgaaggacacggcgcgcgcatttatatcgatccgaaaagcctggtttatctggatggcacgcaagtcgattacaccaaagaaggtttgcaggaaggattcaaatttgaaaaccccaatgtcaaagactcctgcggctgcggcgaaagcttccacgtttaaggcataaaaacggcgggaccgtatcaaaaccgtcccgccatttttacgcttactgcctgttgtagctgcctttgcctttccttttccgttccaccttgtgccggaacaaat

SEQ ID NO: 38470 - DNA, 345 bp, Neisseria meningitidis
gacgtcgaggttgatggagtggctgtacccgaccagcaccagaaccggtgcggtttcaccgacgacgcgcgcgatggacaacaagatgcctgacacgatgcccggcatcgcgatcggggcgacgatccgcacgatcgtcatccatttcggaacgcctaacgcgtagctggcttctcgcagttcatcgggcaccaacctgagcatctcctcgcctgcccgaaccaccaccggcaacatcagcaggaccaacgccaacgccacggcaaaggcgctctgctgaaatcctatggtggcgatccacaggctgaagacgaataacgccgccacgatagagggcacgccggc

SEQ ID NO: 38471 - DNA, 311 bp, Neisseria meningitidis
atgggcgtggctttggcgcgggcgtgccgtgccgccggtgcagaagtcagcctgattcacggacagcttcaaaccgcgctgcctttcggcatatccgatacggttcaagccgtcagtgccgaaaatatgcatcgcgcagtgcatcgtttaatcgacaaacaagatgcttttatttctgttgccgccgtctcagactatagggttaagaggaggagtactcagaaattcaggaaagatagaactgccaaaccgttatccatcgaattggctgagaaccccgagattttggcttctattgcctcattagcgaa

SEQ ID NO: 38472 - DNA, 102 bp, Neisseria meningitidis
agtgggtgtcgatatttacaacttgggtaacttcacccgttccaaccagtctagcaatatcaatcatcgtcctgccgtcaaagccggcgatgttttgcaacg

SEQ ID NO: 38473 - DNA, 259 bp, Neisseria meningitidis
cctgtcgtcttcggcatcgccaaagaaggctcgctcaaacgcgtcattaccggcgaagacgagggaacgctggttcactgctgattgaccatagtgtcggcagatatagtcgcatatgggcttcagacagccatttattatatggagattatagtggacatcccatggcatcgacatcacctctggtggcagcatccacgcctaccccaccgcattcgatgcccccaaaggcagcactaacatcgaggctccggcggaa

SEQ ID NO: 38474 - DNA, 212 bp, Neisseria meningitidis
aaactgacgtttgtctttccaggatgaggtagaaccatgatttatctgtttacaggaaacatggggacaggcaaaacctcccgcgtcgtctctatgattttgaacaacgaacacggattgttcaaaatgaaattggcacacggcacatatgtagacagaccgctttacttctgccatatcgacggattggataaaccgcagttgaaagccca

SEQ ID NO: 38475 - DNA, 497 bp, Neisseria meningitidis
  misc_feature (231)..(231): N is any nucleotide
tccatcgggtcgagcgactcgtccaactatgccgccttcctccgctacggtatccgtaccagcctgcagtccaaacatgtcttgcacaacttgcggcttccgttgcacaagccgataaccccttcagttatagtggacagcaaccgctttttgaaagacagcagtgatattgtgttggattttccgtttaaagattgtgtgttaaatggcggacaaagcaccgaggaaggcgaagaaatttattttaaacgcaataacagccagccagccagccagccagccagccagccagccagccagccagccagccagccagccagccagccagccagccagccaattatacactaaattaacccgagagagacaagaaatcttttttaatcaaacccttgcttttgatgaaattgatcggctttttgacgcacaagcattctcaaaattctctcgctataccgcagacggcaagcaagccgtttgcgcaaatcaaacgacat

SEQ ID NO: 38476 - DNA, 485 bp, Neisseria meningitidis
  misc_feature (231)..(231): N is any nucleotide
cagttggcattgttagataatttgattcacaaatgggcggaaactggttcgaactggggcaaaaaatcaccaatgygactttcaaccgaytggacgcaaacggctaatgaaggtattgcactgacaccatcccaagtagcacaactaaaaaagaacgctttagtttccctttctgataaagctaaagcagctattgacgccgcccgcgaccgcattgccgtgcttgatgcntacacggggcaggattccaacacactctattacatgagcgaggaagatgcgcttaatatcgtcaaagtaaccaacgatacatacgaccatctcgccaaaaacatctaccaaaacctgttgttccaaacccgtttgcagccatatttgaatcaaatcagtttcaaaatggaaaatgatacgttcactttggattttagtggtcttgttcaagcatttaaccatgtcaaagaaagtaatccgcagtggtaccgagc

SEQ ID NO: 38477 - DNA, 399 bp, Neisseria meningitidis
  misc_feature (231)..(231): N is any nucleotide
taatgcctgtaaatccatgtctttaacggcagctctggcagaagcggccacaagttcttgttcgaccgcaaagcgtttacctccgccatgcgatggaatacctgtcagtgtcccgcaggcggataaaataaaaactgaaaaaagaataggtatcagcagccgtgcttgcatagattttctcctttgatgaaaaacaaattgtatcaaaattgtaaatatagtggattatcngtcggcgtaacgctattggacggttcccgtcatgccccgaatccagtgaaggaaattgaagtggcccgcgtgttacaatatatcggactgcaaagcggttcgaccacggaggcagccgtccgttttatgctttagtgtatgcggcagcaggttttttgggacggcaac

SEQ ID NO: 38478 - DNA, 1065 bp, Neisseria meningitidis
cgtacggctttctctaaaaatacctaaaccgtcattcccacgaacctacatcccgtcattcccacgaaagtgggaatccaggacgaaaaatctcaagaaacctttttacccgataagtttccgtgccgacagacctggattcccgcctgcgcgggaatgacgaagctatccatacggaaacctgcaccgcgtcattcccgcgaaagtgggaatccagaacgtaaaatctcaagaaaccgttttcccgataagtttccgtaccaacaaggctggattcccgcctgcgcgggaatgacgaagccatccgcacggaaacctgccgcgggcatttcggatatcgtggttctggcagcttggcggcaggatgcggaagacttcaacgaagcctattgccgccatgtacgccgcaaaatgaacataccggaacatttggcatattttgccggagagccgattatgatcaggcagaacgactacgcgcttgaactgttcaacggcgacatcggactgattatggaagatgtcggacggcagggcagccttgccgcctattttgccgatgcggacggatttaaaaaggtagcggtaagctgcctgcccgaatttgaacccgcattcgccatgaccgtccacaaaagccaaggttcggaataccgggaagtatggctgctgccgccttccgccgcaccttcggacgaaggggacgatgcattgtccggattgagtaaggagctgttatataccgccattacccgcgcgagagagaagttcgtattcttcggcggggaagaagccttccggcaagctgccgccaccgtcaaaacgcgtcagacggcattgggcagtatgctcgagcgggtattttcacaagaataatccgcccgaatgccgcgccgccgccccttatgcctttttcaaacggtataggaaagtggtttcccgggttcgcgcaaaagcaagcggatcgctcggattcgcggcttttttgtgcttcggcttggttttcatcatatcggcaacacgcaaacccgcctgagcaaatgccttatccatgaaaatcggatg

SEQ ID NO: 38479 - DNA, 621 bp, Neisseria meningitidis
cgctgcggcataaccttccgccttgtcgacggcagtataggcagccgtgttgacaatggcgtcgggttggaaacttttgaccatgttgcagacggcatcggcatcggtaatgtctagggatgcggaatccgtcgcaatggtttcccagtcttccggaagacggtcgcgcaggcagcgtgccagttggcttttcgagcctgtcaataggattctcatgaggtatttcctttggtaaaagtgtattgtaggacttgctgtcggtattatagtgccaaaattttgccgcctgtcgggcaaccaataaatcgactttgcccagtttggcggcagcggtaacagcatgcaaagtggtatgattcaactgtttgttgtcgtgttcgacaataatcaatacactcatttcagcctcctcaaatcactttggcttcgtttttcaatttttcaaccaattcggcaacgcttgctacttttacgcctgcctgacgcgccttaggttcggcaaatttcaccgttttcaaacgaggtgaaatgtcggcaaccaaatcgtcaggagtcagtttttccaaaggttttttctttgccgccatgatattggggagtttgacaaagcgcgggtcgttc

SEQ ID NO: 38480 - DNA, 176 bp, Neisseria meningitidis
gggtactaaccgatgactttgacgaacgaagcgcgttcgcccaagcgttccaatgccgtctgaatctgcgcgtaccggcggtgtccttcgatgtcgatgaagaacaggtattcccacaaaacggatttgctcggacggctctcagactaggtcatggaaatacccgactccgtcag

SEQ ID NO: 38481 - DNA, 204 bp, Neisseria meningitidis
aaccgcccaagccatgattgccaaacacatcgaccgcttcccgctattgaagttggaccaggtgattgattggcagtcgatcgaacaatacctgaaccgtcaaaaaacccgttacctccgagaccaccgcggtcgtcccgatcgtccacgtggtgtccatgttcaaagccgttctgctaggacaatggcacaacctctccgatc

SEQ ID NO: 38482 - DNA, 245 bp, Neisseria meningitidis
ccgcataatcgagtgtacccatttcctgcttgccatcggtttcaaacccgcaagacaagggcgaaccgctcaaagtcgccgcttcacatcttcctgcagccgcccgccgcgacatgaatgtctatctttcaggctggcaactgattgacggtatggtaaacgtctgacgcatcgtccacgaccactaaagcgaatgttgcggcttcggcggcacattctccgtcaaacaagccgatatttccggc

SEQ ID NO: 38483 - DNA, 273 bp, Neisseria meningitidis
gtatgggttttccggcgcggggaaaacgtcaggcatcgcgccgtatcgaaataaccggacccgcagacccaacggcagtcctgaacgacgacctcgtccaacaaagccaggtcttcctgcaaagcgcggacattgttcagcacatgccgcccgaaatggggaatctgcgccgaaggttcgggcacagtacggtgccggtagcggtttcgcaaataagccgtatcggtattgctttcagcctcgatattcggcacagcgtgtttttgggcataa

SEQ ID NO: 38484 - DNA, 154 bp, Neisseria meningitidis
attttgctcaatattaggaaggttttaagcaattgaaaatttgttggcgcatttttatgcgtcaaatttcgttaacagactagttttgcaaaggtctctatattgttcgatatttttgaagacatcgattttttagggaaacgattgtttacgg

SEQ ID NO: 38485 - DNA, 362 bp, Neisseria meningitidis
cgttaaacgacgcagccggcactgcgcattaaaaacgtgccgattgtaaacgccgccaataccgccaaatcgggaatgccgtctgaagccagccacaatgcccagtaggtcggccacagtaaaagcagcgtcccaatgggcttgtccgcccgcatcaggcgcaggtacacatccaaacggtcggacaggcgtaaaaataaaggggatttaggattcatattgccgcgcagcttgaaaaaacggtattttagccgagaaaacgtttcagttcgggcagaaaatagtcggtaaacacgatttcgtcaacgtgcccgccggctcggtaatgctgcgcgtgtcatcgaaaatatccttgatcgcgc

SEQ ID NO: 38486 - DNA, 274 bp, Neisseria meningitidis
cggctgcttctatctttgatgctccaccataaaggtattgcccgaaaccggcggatggaggttttgtttttctgccgccgcccgtgatcgcttcgtggttcgccaaacgcgcctgttgcagcctcatttgcgcataatcctgctccaaggcgatttcctgtattttcgccttatccaaagctgtgatattgagcctgtactggttttgctgcatcacaacggcaaaagcggcaacgcacaccgcatccagcagaaggaaattcactttgttcat

SEQ ID NO: 38487 - DNA, 446 bp, Neisseria meningitidis
cccatactatatgtcttaagtgaggaatacatggttcattgatgaacccaaatttgacccttgtagcagatgctgtcagtgccccacccatatgttctttgcctgtcagacaacgatacagcccttgtcggtacgaatatcgtctatgccgccatccacaacttcggcggtatggcggggcgcaaccgcaaagttcggattccgcaacgggaatttttgacgctgacggacgacgacaaacaggctttgatggacgatgtgcaggattatttttcgggtctgataccgtgaatttataaaaccctcaaaaacgcgctttttagcgcgtttttttatgcgggtaatacaaacccctgcccaagatataaaaatcaatcctagacgcttcgaaaaagcccctgaaaacgattaattgtgtatcgcgcggacaggttttaaaaaaatgg

SEQ ID NO: 38488 - DNA, 146 bp, Neisseria meningitidis
gcttcatcgtcttcatcccaatctgaccccaaacattcgccttttggtttgacgtgatgacaggtaaacatacctttaattcggtcttcacgggcttggttcgggctgtattcgacgttgaaaaagtcatttgcgatgtcaacgcg

SEQ ID NO: 38489 - DNA, 303 bp, Neisseria meningitidis
caatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatg

SEQ ID NO: 38490 - DNA, 455 bp, Neisseria meningitidis
tttaaaatggaaatttgaacttttatctcactgttgttaaaacgccgttcgtacccctttaaatacagctcaaaatgcgctttgggaatgccgtcaaacttgcgtaaatgacgttttgcccggttccaaaagttctcaattccattgatatggttttgtcgttcagcaaaataactttcatctgcttctacttcgccatcaaacatttccaaatgcggactgttttgataaataagtaatcgtaaacgatgaaaataataggctgcggtacttttattaacgcctactaactctgctgtcgttcttgcagttacacctgcgacaaacagttcaatgagtttatttgtttataccggcttagacgactttttctcataggggcaactctaacttaatttgaatttccctagttatccctaaaggggggaaacccaaaagggggccccccccccccc

SEQ ID NO: 38491 - DNA, 739 bp, Neisseria meningitidis
  misc_feature (536)..(536): N is any nucleotide
  misc_feature (687)..(687): N is any nucleotide
cgaatttgtcggcggcggcgcggcaaaatcatactttgcaaaatttaacaatttgcaggggcagaaaacaggaagctttcctttttcgtcggaaaatccttatttcaccgccttgtagccggagccggtcaaaaggcaaaaaatttacccgttttttatcggtaaagaattatcagataaaacaaatattataggaaaaatacgacaggcgggttttatcgcgcattgcctgaaactgaaaaatacaaccgttgtcaagactggagaaaatgccaaaaatccactatattgtctgccttaatttatttgaaaagactgtgtcttgaatatcaagagtggaagaggaagcgatgaatacaccgactgatttgaaagtaaccaaacgagacggaagattagaagccattgatttggataagattcaccgtgtcgtcacttgggcggcggacggattggaaaatgtttccgtgtcgcaggtcgagttgaaatcgcacatccagttctacaacggcatccgcaccgacgacatccacganaccatcatcaaagccgctgccgatttaatttcggaagataccccggacggtgatgctgccaacttactgatttagtgtatgatggtgtttttgaggtgctccagtggcttctgtttctatcagctgtccctcctgttcagctactgacggngtggtgcgtaacggcaaaagcaccgccggacatcagcgctatctctgctctc

SEQ ID NO: 38492 - DNA, 264 bp, Neisseria meningitidis
ctagagatccctggaaaaacacacagccggcacacagactatctcgcctaccgcgacgcgattgccaacaaactgctggaagtccgtttcgccactcggcaaatcgacagcctcagcagcagcctgcgcgggaaagtagaaaacatccgcagactcgaacgcgaaatccgcgacatctgcctcgaccgcgtccatatgggacgcgactacttcatccaaaacttcctgcccgaaatcaccaatctagaatggattgaagaagaa

SEQ ID NO: 38493 - DNA, 438 bp, Neisseria meningitidis
ggtcagcccggcaagggtcgaatatctgatcgatatgccgatggaactgttgcagaaggcggagggcggcgttttgtatgtcggcgacatcgcccagtacagccgcaacatccaagccggtattgcctttattgtcggaaaggcggaacaccgccgcgtcagggtggtcgcatcgggcagcagggcggcaggttcagaccgcattgcctgcgagaaaggtggcatgattgctgtcggcatcggtcgtccgtattccgccgctgcgtatgcagcatgaagacattcccttcctgatacaggggattgcctgcaatgtggcggaaagccaaaagattgcgcctgcctcattcagtgaataggcacttgtcgcattgcacacgttcaatggctggcgttctattcgaccaactgcaaagcgtcgttgcaacgctgttgttg

SEQ ID NO: 38494 - DNA, 290 bp, Neisseria meningitidis
catttccatacctatgaaatcaatagcaggatttaagttcaagttcagctccagatcttctaagctggaggacaaaaaggcgaaaagatatgtactggtttcgcctcttgtttgcttcttgctgatcaagaacctccccgatgtattcgcaaacaaatgtgccacgcagtatatgttcacaagctcgcaatccccatccctgttgatcaatcagttggatattggaattgaatcaagacaaatgggttaaagacaataactcaaaaaggatcacaccttgctttcagttc

SEQ ID NO: 38495 - DNA, 429 bp, Neisseria meningitidis
aaggggatactagagcatactcagtgaagaagcaaagaaaatcaacaggtttcagtagaaaaaaatcgaaactgggatcgtaagtttaccaggaattgacgaaacccgcgaatctcgttactctcttcgaaagccccaaacacgaaacagtcttgtcagttgctcaagctccgtgtttcctgagaaaaaacccataacctaatcaacaacccaattgttaaaaatccatctttatgagaaacaaagagaagctaaatcagagaggaaagttggttcatacctctgagtctgaccagagacgacggtagcaaaaacggaaatttgatgcgagaaagccgagagggtttttcttatttattttttagtcctttaaaccgacctttgacaaaaaaaaaacgactttgtgaaaacgggccggttcatattggg

SEQ ID NO: 38496 - DNA, 107 bp, Neisseria meningitidis
tcgtggtcgaaccctacatcatccgccatgacgttccgatcggtgaacgcagcaactaccacctctccagacatatgaactttatacggcttgggcggctgcggagg

SEQ ID NO: 38497 - DNA, 494 bp, Neisseria meningitidis
caaaatcgaaggcgggtttgtcgtgttactcggcgtaacgcatagcgacacagaaaaagatgcacgctatatcgccgacaaaatcgcccatttgcgcgtgtttgaagacgaagcgggcaagctgaacctgtctttgaaagatgtcggcggcgcggtgctgctggtgtcgcagtttacgctttatgccgacgcggcaagcgggcggcggccttcgttttcccaagccgcacctgcagaacaggcgcagcagctttacctgcgaacggcggaactgttgcgcggacacgggattcatgtcgaaacagggcgtttccgcacgcatatgcatgtctctaacgtgctgaagcaccaagtgaatcggttccgtactatctgtactgtctgcggcttcgtcgccttgtcctgatttttgttaatccactataaagaccgttgggcatctgcagccgtcattcccgcgcaggcgggaatctagtctgttcggtttcagttat

SEQ ID NO: 38498 - DNA, 916 bp, Neisseria meningitidis
tatgcttgggacaatagcggaaaaacaccgccttgcgttcggcaaaacgggaaaaccgcaaggcgatgtcctgatacggattcggtttctgctcgtgcggcaaaacgatgttcagccccaccgaaaccgacttccctgcaaacgcgcccttgtttgccgcctccataatccccggcccgccgcccgaaatgacggcaatgcccgaatccgacagccgccgcgccagacggcaggcgaacgcataatccgcatgattctgcggcgtgcgcgcgctgccgaagatactgactgccggaaacacgcccgccaatgcttcgtctgcctgcctgcgttcggcatcataacgtgcctgctccggcacacggtttgtattctccattccatcctccgttcaaaaacagcgattgtacaccgtcaaaaacgtatagtggattaacaaaaatcaggacaaggcgacgaagccgcagacagtacaaatagtacggaaccgattcacttggtgcttcagcaccttagagaatcgttctctttgagctaaggcgaggcaacgccgtactggtttttgttaatccactatcatatagatttttatgccatttggtcagaaacagcgaagacaggcagggaaacgccttcagttccatcgcgtcttcaaaatcatcccaaacatcgctcaaattctgtttggatatgccgtattcccgtccggcaaacatcacggtctttttgcttttggcggcttttttgaatgcctttctctgtttttcgggtatctgctgccatctcaactgacggtacacgtcgtagccgtcgccccaaaaagaggcataccgttgcgtgtcttcgccgaccagcggcgcggtattcccaacccgtacatatcccgtcggcacgacggcacttgccttatatatgt

SEQ ID NO: 38499 - DNA, 669 bp, Neisseria meningitidis
aactacacaaccacgatttagcgaaaggtataaaaaatgcgggtcagaatttaacatcaatgcaaacgcttgatgagcataataaaccattgatgactgcgcatttaaaacgagatacacttaatgttacattatctcgtcaaacactaatcagtattattcagtcttatgtacaacaagacagcatttatttaaaacatggcgtaactaaaatagataatagtaattcaaaagtcattcttcatttcatggaacaagaaagtgaagcctttgatttatgtattggtgcagatggcatacattcaattgttagagaagctattgatagccaaagcaaggttcaatatcaaggctatacatgcttccgtgggctagtcgatgatattcatttagatgaaacggatgtagctaaagaattttggggcaaacaaggacgcgttggtattgtgccattaattgataaccaagcatattggtttatcataatcaacgctaaagaaaaagatgtcaaataccaatcatttggtaagccacatttacaagcacgatttaatcattatcccaatattgtaagacaaatattagataaacaaagtgaaacaggcattatattaaacgatatttatgatatgaaaccactaaaatctttcgttaaagagcgtactattt

SEQ ID NO: 38500 - DNA, 627 bp, Neisseria meningitidis
atatgagcgtcggagttataacgaaagacatttatacaaaagaagacgaaaagatcttagttaatacaggtgtcttacctgaagatagaattattggtgtagaaacaggtggttgccctcatacagcaattcgtgaagatgcttctatgaactttgctgctattgatgagttattagaacgtaatgatgatattgaacttatctttattgaatctggtggcgacaacttagcagctacattcagtcctgaacttgtagatttttcaatctatattatcgacgttgctcaaggtgaaaaaatccctcgtaaaggtggacaaggtatgattaaatcagactttttcatcatcaataaaacggatttagcaccacatgttggcgcatcgttagaacaaatggctgaagatacaaaagtatttagaggcgacagaccattcgcgtttactaacttaaaaacagatgaaggtcttgatgaagtgattaagtggattgaacgagatactttacttaaaggattatcataatgtctcaacaagcttggacaggtcaacttgatttaaccgtatttaataatggaagtcgttccgttgcacgtgatatcttttttggaaaagcattaaaagttat

SEQ ID NO: 38501 - DNA, 128 bp, Neisseria meningitidis
aacaatcattatgaacccaaaccccttccgtttccgcctgactgcccttgacgaagtacgtatgccaatcggcgacggtcaaattgtaagctttgaccggctgctgtttgaaggtaatgttctgaacc

SEQ ID NO: 38502 - DNA, 480 bp, Neisseria meningitidis
gtacggcgttaccaacctgctgctgctgggcaattttgctgccgcacaaaataaaattatcagggaaagattgtaaggcagctaattcactaacggttaacgcccgattctgttcatattgaaaaactttgcgcatatctcctgtaatacaaacggctggttttgttgctgttgtcacggatgtatttacggatatcacctgttttcggacgtaatggttcatgaatatcgttacggttacctccatttttaacaaatgccattttttctaacatttgtgccgaatgattcatatcttcatgatttgcaacgtgtggattgctttcgccatcatccagttttggaaaatgtcctattgctgatccaacagtctgatgggaaatctgcaaatgttcaggaaatgaaattttgcctttatccctcctcccgataaatatcactcggctacttatcttaggaacaccgaaatcggctgcactc

SEQ ID NO: 38503 - DNA, 650 bp, Neisseria meningitidis
tcgacattgccaacagcgtcccgggtgtttcggataatatgacggacaacggcagaaccgataaagcccgcgcctactggcaacaagtgccgtctgaacagcacgaagccttccgtttccaccatatttccaccgatgaagtctatggcgatttaggcggcacggacgagttgtttaccgaaaccgcgccctacgcgccgtccagcccctactctgcctctaaagcgtccagcgaccacctcgtccgcgcgtggttgcgtacttacggcttgccgaccattgtaaccaactgctccaacaactacggtccttaccattttccggaaaaactcattcctttgatgattctgaacgcgcttgacggcaaaccgctgcctgtgtacggcgacggtatgcaaatccgcgactggctgtttgtcgaagaccacgcgcgcgcactgtatcaggttgttaccgaaggtgttgtcggcgaaacctacaatatcggcggccacaatgaaaaagccaatattgaagtcgtcaaaaccatctgcgccctgctggaagaactcgctcccgaaaaaccggccggtgtggcgcgttatgaagatttgattactttcgtacaagaccgccccggccatgacgtacgctacgccgtcgacgcagcc

SEQ ID NO: 38504 - DNA, 169 bp, Neisseria meningitidis
cgcgggaatgacgaatccatccgtacggtaacctgcaccacgtcattcccacgaacctgcatcccgtcattcccacgaaagtgggaatctagctttttgagtttcagtcatttccgataaattgccttagcattgcatgtctagattcccgcctgcgcgggaatgacgc

SEQ ID NO: 38505 - DNA, 170 bp, Neisseria meningitidis
gcggcagacaagaatggctcgaggcgttgcgacaggccctgcttgcatctaaaatcatttcctacgcacacggctttatgctgatccgcgcagcggccgaaagctacggctgggatttggcctacggcaccactgcgctgctgtggcgcgaggggtgcatcattcgcagc

SEQ ID NO: 38506 - DNA, 126 bp, Neisseria meningitidis
atccccgaggaatctaggtctgtcagtgcggaaacttatcaggtaaaacggtttcttgagattttgcgtcctggattcccactttcgtgggaatgacgcgattagagtttcaaaatttattctaaa

SEQ ID NO: 38507 - DNA, 265 bp, Neisseria meningitidis
atccccaaaatttttttgagtttctcaaaagcgatatgattagactgttgagaggtgaaagtaaaacaacagactttcaatggccgcaatttgatgaatagcagcaagctgtagcctgcatgaaacctaaaatccatgcgtaaggtgtgtgcttcagcacgcacgcgttccatgatttacggctcaatgccgtctgaaaagctcacattttttcagacggcatttgttatctaagccagtattcagcttcactatataccggcca

SEQ ID NO: 38508 - DNA, 375 bp, Neisseria meningitidis
gccaacctttatcgtaaacatattcaaactgatagttcccgaaactctcgatatccgaactaaaaaagaagaagagcagagtaagaggcaatagaggaacaagtaagaacaaaaatagcaaaattttcaacttagttaacaatagttacctctcctttaaattcaatcctgaaaggtaccccttacccggggcaaccaattatagttcccatatttcaaaatatggttttaacattacttttttccccccccaagggaatgcattttaaaatcaggcttttcaggtgcaaaccgatacttaccattaccatctttaaccacagatatatttccaggtatagcccaacgtgaaaaatcggagtattatatacagtt

SEQ ID NO: 38509 - DNA, 375 bp, Neisseria meningitidis
cgtatcgacatttccattaatctcggattcgctcgcgggacagagcagtgacgatggaggagcgagccagatgcgcatcgtcgccaacagatctgcaacaactgcgatcgaccaaacgcgatttgtctccgccacgtcataccggctgatccaattccgaagaatacagagagcatcatcctccaccatccgcacgagtataaagcttgtgctaaggaaggaaccattgggaggatatgtaactacggcgcttaggagccattgaacctgacggtgaataaatcgagaggaagcttattagtgtttagaaagagatggtgaggttccaatctaactcaattgatgggttaatttgttgtttctattccgaagaaa

SEQ ID NO: 38510 - DNA, 573 bp, Neisseria meningitidis
  misc_feature (537)..(537): N is any nucleotide
gcgaaagaacagaagtcattgatgagaacaggtttgtcgcgtgttaaaataaacgaattttatgtaataaatactggtatctacatagagtattataaaacatgcgtgtgattaatctacgtaggtaagcagcaaattcagtcaaaagaagaaacatcatcgaccatctctagtgaattactgaaaactgaagaaattatctcatccccgagtcaaagtgaaccgtggactgtacttgctcataagaagcctcagaaggactggaaagcttacaacccaaagacaatgagacctccccctctaccagagggtaccaaatgtgtgaaagttatgacttggaatgttaatggactgagaggattgttgaagtttgagagcttctctgctctgcagcttgcccaaagagaaaattttgacatcttgtgcttgcaggagactaaactccaggtcataactttagacccttcttaagttgtttctgctctatattttaaacacagccaatctagaaatctcttgtactaaagacatacgcanacttatgacaggtgaaagatgttgaggaaattaaga

SEQ ID NO: 38511 - DNA, 292 bp, Neisseria meningitidis
ttgctgttcaagctgtttttcaagattctcgtaatattcgtacatataataagggtctttgtacggtttgaatgcggtctgttcatgaatggcttgagctttcaaaaaggcgcagtcgtacgcttcgggagccaaagacttggtcagcttgtgatgactctgctcaatcagttcaaacagtttggctttgtccaattcgggaaaaatgaatttcagaccgtttgccgcacgtccgaactgtttttttacccattcacagtatctgtcggctgaaatcgacttatcttcctta

SEQ ID NO: 38512 - DNA, 208 bp, Neisseria meningitidis
ggtaatgatgaatgatagttttacaaaagtttcggactacaatttatacgtttataataataacaatatccatcaaaaaaatgtgatttttctttttttaaaagttgcatcttgccattcttgtaatcacattcgtaatattcagcatttttcaaatctgaatcaaatagatattgaggtaaaacattcccttccttatctagttcta

SEQ ID NO: 38513 - DNA, 502 bp, Neisseria meningitidis
  misc_feature (452)..(452): N is any nucleotide
  misc_feature (483)..(483): N is any nucleotide
ggcgcgggacccatgctttggatgcggtacagccgtcgcgttatgttttggggttcggatacgaccagcctgaggggaaatggggcgcaaacattatgctgacctattccaaagggaaaaaccctgacgagcttgcttatctggcaggcgatcaaaaacgatattcgacaaaaagagcgtcgtcttcttggtcgacggcagacgtttccgcctatctgaatctgaaaaaacggctgaccttgagggcggctatctacaatatcggcaactaccgctacgttacttgggaatccttgcgccagactgcggaaagcacggcaaaccggcacggcggcgacagcaactatggaaggtatgccgcaccgggcaggaacttcagtctcgcgcttcgaaacgcggacgttgtccgcagtggagcatatggacggcataatcgtttaaaacggtttggngaaagtgtgaaaccaatacgtcgcaaggtancagcaagctgtcgcgttct

SEQ ID NO: 38514 - DNA, 525 bp, Neisseria meningitidis
tatctgaaagtccgagattctacattcccgctttcgcgggaatgacgaaaagtggtgggaatgacggttcagttgctacggttactgtcaggtttcggttatgttggaatttcaggaaacttatgaatcgtcattcccgcgcaggcgggaatctggtatttcaatgcctcaagaatttatcggaacaaaccaaaacccttccgccgtcattcccacgaaagtgggaatctagaaatgaaatgcaacatgaatttatcggaaatgaccgaaactgaacggactggattcccgcttttgcgggaatgacgggattttaggtttctgattttggttttctgtttttgagggaatgacgggatgtaggttttcttaagcctgcgtcctagattcccgcttttgcgggaatgacgggatgtgggttcgtgggaatgacgttgtgcaagtttccgtgcggatggattcgtcattcacgcgcacgcgggaatccagaccttattgcaacagcattattcaaacattatctga

SEQ ID NO: 38515 - DNA, 251 bp, Neisseria meningitidis
ccctgcaataaaaagattccgtttttcaaataatattcgaaactctggcgtttttttccactgtcgaaactccaatagactttttgcggaagaccgtccgcatcatagccgaccacaagactgttcgccttcatccctcggggcatcacttcccgcatactctgataatccacagaattgcgcgagtccgacgcagttcggttgctctctttgcggaagtcgcaaaccttctgctcgtcattcgcgacatc

SEQ ID NO: 38516 - DNA, 603 bp, Neisseria meningitidis
caggtcaaaaaccttattgcgtctggctttccgaaatcatgctccagcaaacgcaagtcgccaccgtgttggactactatccgcgcttcttagaaaaattcccgaccgttcagacgcttgccgccgcgccgcaagacgaagtgttgtcgttgtgggcgggcttgggctattacagccgcgcgcgcaacctgcacaaagccgcgcaacaagtcgtcaggcaattcggcggcacgtttccgtcggagcgcaaagacttggaaaccctctgcggcgtaggcagaagcaccgccgccgccatttgcgccttctccttcaaccgccgcgaaaccattttggacggcaacgtcaaacgccggtagcgtccaaggcgtagtcgtccaaatgacggcaaacgctttgccttcgaaaccagccaaaccgaatgcggcggcaagcgcggcagtgtctttaaacagataggcaacgtcaatcgcgggcgagattttgtctttgtattccacttccgcttcggccagcgaagaaccgcagtccaagcagaattgaaccggtttcgcaccccggtagagatagccggatttgtagatttcgccgagcatacgcacg

SEQ ID NO: 38517 - DNA, 642 bp, Neisseria meningitidis
gtcgactcatagaggatccacgaatctagaccttagaacaacagcaatattcaaagattggcggattcgcatttgaagtgcaactttccctaacagaaaaaggccagtatgcggtagcatacggcctttcctgcaagaaagattgccatgagctacacgcaactgacccaaggcgaacgataccacatccaatacctgtcccgccactgcaccgtcaccgaaatcgccaaacagctgaaccgccacaaaagcaccatcagccgcgaaatcagacggcaccgcacccaagggcagcaatacagcgccgaaaaagcccagcggcaaagccagactatcaaacagcgtaagcgacaaccctataagctcgattcgcagctgattcagcacatcgacccccttatccgccgcaaactcagtcccgaacaagtatgcgcctacctgcgcaaacaccaccagatcacgctccaccacagcaccatttaccgctaccttcgccaagacaaaagcaacggcagcacgttgtggcaacatctcagaatatgcagcaaaccctaccgcaaacgctacggcagcacatggaccagaggcaaagtacccaaccgtgtcggcatagaaaaccgacccgctatcgtcgaccagaaa

SEQ ID NO: 38518 - DNA, 551 bp, Neisseria meningitidis
gcgggaatgacggcaaagtggcgggaatgacagatcgggcattccttaaattacccgtgtatcgctgtaaatcttacagatggcggcatatagtggatatccgcaaaatcggcgcggaaacaggggtaaccaaaatccacctcaacgtccacgtcaaccacgaccgtgccgacgcgcaccgcctgtatttcaaaaacggttttgaaatctgcgcataccacttccgttgcgaccccaaatgaaaacccccctccccatctgcaccctgtcggcactcgccgcctgcaccctttccggacaaggcggcagcagggtttacggcgaaatcaaagcccgagacctttgcgttaccgctcctatcctgctttctgctttctgtcttgcctgctctcgttgagccaagcgttcttgcaagctcgcttgcacgttggcaagcattgcactctatccgctttcttttcctgttgcggctggtggttcaggctcgcgttgtacgctttgcactaaagcgcaccgtgaatcgatgctcgctatttattctatcaatattt

SEQ ID NO: 38519 - DNA, 780 bp, Neisseria meningitidis
ttgggaagttgtccgtgtcggacacgttttgtgtctgaccgttatgtagaagggcaaaaatgataatgaccgccccgttgcgttttggagaagagggtaaaggcagaaagcatatgccgtctgaatgatatttcagacggcattttatattgcggcggcactcagtccgtgtcgctttcaggcaactctgccgaacccatgcgtttgagcacgatattggttttgttgcggagccgtttgcttttcggatggtcggcgtagtagagcggggcggggacgcgcgccgtcagttttgccgccgttcaaaaagccaattccggccaccccggcgcgcctatgggtatggcggaaatggcggaaacattgtggacgaaattcctcaatcacaaccccgccaaccccaaattctacaaccgcgaccgcttcgtcctctccaacggccacgcgtctatgctgttgtacagcctgctgcacctgaccggctacaacctaagcattgaagacttgaaaaacttccgccaactgcacagcaaaacccccggccatcccgaatacggctacaccgacggcgtggaaaccacgaccggcccgttggggcaagggattgccaacgcggtgggtatggcattggcagaaaaaatccttgccgccgaatttaataaagacggtttgaacatcgtcgatcattacacctacgtctttatgggcgacggctgtctgatggaaggcgtatcgcacgaagcctgttcgctcgccggcaacttgggcttgggcaaactg

SEQ ID NO: 38520 - DNA, 413 bp, Neisseria meningitidis
aaaagcgggagctccaccgcggtggcggccgctctagaactagtggatcccccgggctgcaggaattcggcacgagaagggacttattacattggtacagacatatttatgctttcttccatcaccaaccactaaacccctttggaggaatgaaataactgcataaactagtcaactgaacactgggccacttacctcaatgttatacaaagtcctggatgatttgattctgaaccacagcctttgcaggagttgggggaatcagatttgctcatgaagacatccctttccacttttgtcatgggcagtaaatactatagtttacaatgcctaccaattagcaaaggatcattcattcagctactcagttcctctgtaaaacaggtctatgtatgtgcaattcagctaagatc

SEQ ID NO: 38521 - DNA, 532 bp, Neisseria meningitidis
tacgactcactatagggcgaattgggtaccgggccccccctcgagtttttttttttttttttttttctgtattgaaactttattacaaaattataaagcagagctctgtaacaaaataatacacatttgggtttgctttaacctccaagtaagtctgagaaaatcttaataaaagccacttgaagtaacaattcacatccaagagatttccacaaatttatacaatgtatattgagcactagttcctgtacagcttattcttattagtttggatccaactattccaatgtattatgaaccagtcagctatctgtcttttgaaacaagtcttaactgaaatctcagagtaatcagcaaaagctacggaataattctaagaattagatgtttccatatcattaaaaccaaggatccatgaggggcagaagggaggattcaaagatttaaaaaaaatcaaattttagaccttggttaaatattaactggaatgggatcttggaactcccaactttaatttggtgtaataaaaatg

SEQ ID NO: 38522 - DNA, 385 bp, Neisseria meningitidis
tgtttccctcttgacaacggacgttagcacccgctgtctgtctcccgaggaaccacttgatggtattcttagtttgccatgggttggtaagttgcaataaccccctagccataacagtgctttacccccatcagtgtcttgctcgaggcactacctaaatagttttggggagaaccagctatctccgagtttgtttagcctttcacccctatccacagctcatccccgcattttgcaacatgcgtgggttcggtcctccagtacctgttacggcaccttcaacctggccatggatagatcactcggtttcgggtctacacccagcaactcatcgccctattaagactcggtttccctacgcctcccctattcggttaagctcgct

SEQ ID NO: 38523 - DNA, 411 bp, Neisseria meningitidis
gctcggctcatggaaacgaaatacatcgtatctgcactcaaatatcgccccgattcttttgcctcgatggtcggtcaggaggcattgtccgctacactcaaaagctccatcgtacagcaaaagacagctcacgcctatctcttttgtggcccgcgtggggtgggaaagacctcttgtgcacgcatcttcgcccgtgccatcaactgtctggagcggttgccggatggagaagcttgtgggcgatgcgagtcgtgcaaggctttcgatgagcagcgatccatgaatatatatgaactggatgccgcttcgaacaattcggtagatgatattcgtctcttgatagagcaggccaatgtgccgccacagatcgggaaatacaaggtctacatcatctacaaggtacaaatgctc

SEQ ID NO: 38524 - DNA, 486 bp, Neisseria meningitidis
gaatcaatggagaaagtttgatccgatgagataacggtcgtccaatcgaaaagtctgagcctttcataaatttcatctgtcgtcttcgcatggaaagttattacaggtttcaatatgcgcagtgctgtacgcaaccggagattagcaagatagagcatcctcttatctcctcgaaaactgaccatacgccggccgacggttacctcctcagcacccaaggctgttagttcggcagccaagacatcctccaacccataaagggtcttagctaccatagtaaattggagatcgttattcataatagtccatgattatggaacaaagataatgaaatacggccgcagtttatggctttttgagacctgtacggaagtgtgtagattccagctatcaaggctcgcatttcagccactaacgtacatctaaagctcatgatgctacgctcggttatcaaacaagtacgaatccatatatcagagattcaat

SEQ ID NO: 38525 - DNA, 445 bp, Neisseria meningitidis
  misc_feature (286)..(286): N is any nucleotide
gtactgcttatagagatggcttcctgttttcgtatagccccttggatggcaacgatacggtctttaatgcttctctgcttggagcgcgtctcttgagctattgctaccattataccaaagacgaagcgtatcgcacgcttgcgcgccaaacgatctcagcttgctgtgctgcacaagccgaagatggttcgtgggtctatgggatgctacccgtgcagtcatggattgatagcttccataccggctacaatttggatgcactgattgcctatcaagagctaacggnggacatttcctttgccgagaatatagagcgtgggttgtcgtattacttagagcatttcttcgaggcagatggtatgcccaagtattatcacgatcgtacttatccaatcgacattcattgtcctggtcagctcttcgtgtcgctagctagacttcatcg

SEQ ID NO: 38526 - DNA, 429 bp, Neisseria meningitidis
  misc_feature (348)..(348): N is any nucleotide
ggagcgggcgcagttcctccctgcgctggacgaaaatagcatgaacaacctctcggaaaacagcctgaacgaagagagtcgattgctttgggacggctcttcggattgggcagaggcactgaccaagaggatccgccatcaggatcgcttcccctatctgatgcttcgttttatcgaggagatggatctgctcaagggtatacgctttcgtgtcgatttgggtgaaatcgagctggattcttactccaaaaaggtaggccggaatggtgagtacgatcgcacgataacggatcatgccttggcattcggcaagctgtcagacttccagaatgaagaagaggtaagtangatgatcagtggagaagcgtcttatcccgtacgcttctctctctttgctccccgctatgccatatacgacaataagatagg

SEQ ID NO: 38527 - DNA, 465 bp, Neisseria meningitidis
gaaaatacagccttttcgtttttaccggtcaaaataaaatcttctgaatactgtcccataatcatatttgttaatggtcaaatataatgaaagaatgttttgaaaaccaatatgaactgttgcatgggagtttcattgagctcttttgctgcagagcagattcttagtgtcttcgggaaaggtcaaacctccggtatatgggcacaccaagcaaacagaaattttcccaagtttccattagagaagtactcctttcctcgtcaaataggcgagaaataagaaacgattgtcagctgattcttgcttcctgcatgatgcaggacgcgattgtcagctgattcttgcttcctgcacgatgcaagacgcgattgtcagttgattcttgcttcctgcacgatgcaagacgcgattgtcagctgattcttgcttcctgcacgatgcaagacgcgattgtcagctgattct

SEQ ID NO: 38528 - DNA, 1018 bp, Neisseria meningitidis
attccagagtacttaactacggttttaaatgtacctttttatttgggtggcacgtctttgttgattctagttgttgtaacgatggattttagtacacaaataaattcgtataggcttactcaacagtatgataagttaatgactcgttcagaaatgaaatcattttctcggaaatagaattatggcgaaagaagatactatccaaatgcaaggtgaaattcttgaaactttacctaatgcaacatttaaagtaaaacttgagaatgaccatattgtattgggtcatatttctgggaagatgcggatgcattacattcgtatttctccgggagataaggtcacagtagagctgacaccttatgatctaactagggctcgaatcgttttcagagcaagataaaccaataaaaggaaaataaaatgcgtgtacaaccatctgttaagaaaatttgccgaaattgcaagattattcgtcgaaatcgtgtagttcgtgtaatttgtactgatctcggtcacaaacagcgtcaaggttaatggaatatttcttgtaatgtgattctgtgatatagtgacacactttgccctaaaaaggaaaaaatatggctcgtattgcaggggtaaatatccctaataacgcacacatcgtaattggtcttcaggctatttacggtattggtgctactcgtgctaaattgatttgtgaggctgcaaatattgcgcctgatactaaagcccaacatcttttgagcaacagagcccgttgatagccacagctgtgtatggttaaaattctgcccagaatcagaaagaagagcgtacattttggagagcagtcgacctctaagattttcaggaagacgttttgttatttgttcgcaaaaacttctaacaaatggacactcccacataatatgtcaacgtgttcccatttgattcaaattaaatagggtacagtttggagaataggcctatttgaataaaaagtatgctccttagatttgggattgtgtgtcccggg

SEQ ID NO: 38529 - DNA, 415 bp, Neisseria meningitidis
acactgatgttaccgggcatcttgctccagttataggtctcaccgaatgtgcctgaatagtgggtatgcgtccccgtcatatcatcgtagtagtcatattcgccggaagccttctccggccacttgtagtgacgcatgatttgtcccatggcagtggcaacacaaccggtataagcctgctgcccggaaggaagcaggggatgcaaggtgttaaatggatagccctgatcccacaagatcggatccgatgcatgttcgcccgtttccaaaataggggcaatggatgatggcaggtcccgtgtaggcttggcttcacggataggatctatcggctctgccttgccgtccattacagcaggcatttcacgttcataacctttgtgccaccctctgatattgtccggtatacgggccg

SEQ ID NO: 38530 - DNA, 451 bp, Neisseria meningitidis
gaaaagagagcttcatgcgatctctctgcaaacctcaagtaatctgaaaaacacttaagaatcagctctgcggcaaaagacttcaatgaaagtcctataaaatagttgcaaatagctgatagttagcgcattgatgggagcagaatcagctgacaatcgcgtcctgcatcgtgcagggagcaagaatcagctgacaatcgcgtcctgcatcgtgcagggagcaagaatcagccgacaatcgcgtcctgcatcgtgcagggagcaagaatcagctgacaatcgcgtcctgcatcgtgcagggagcaagaatcagctgacaatcgcgtcctgcatcgtgcagggagcaagaatcagctgacaatcgcgtcctgcatcgtgcaggaagcaagaatcagctgacaatcgcgtcctgtatcgtgcaggaagcaagaatcagttgacaatcgcgtcc

SEQ ID NO: 38531 - DNA, 518 bp, Neisseria meningitidis
cactttcacttatacataccccgttaaataagttaagagggaaatatgaaaagtgtagtaacaaagcaggccctcatcggcctgcttttctttagtataagtatatactcccatgcggccaaccctccggcccaacctaccgacaccatcgtatccggcaatatcgcacttgaggatatagtggtgaccggtagccgtacagcccgtctgcttaaagatgtacctgtccccacaaaggtgttcaaggccaaagatatcaaagctatagccccatcttctttcattgacgtactgcagtatattcttcccgggatcgagtttaccaagcatggttccagagatcagctcaatgctcagggatttgacgaaagttctattctcttcctcgtcgatggcgaattgatttcaacgggatctaccagtggaatagacttcgaacgaatcaatccggatgacatcgagcgaatcgaagtgcttcgtggagcttcctctgctttgtacggatctaatgccatcgg

SEQ ID NO: 38532 - DNA, 561 bp, Neisseria meningitidis
gaatggagcaaatgaaaaagcgattctctggcaatgtccaaatgcatctcaatttggacgaatgcaggaatgagttacttgtacctgttttaagtgctgagatacaaatgcaggttaaagagctgtttgaattatccatgcaaaagtcgacagagggaatatccctctactcctctgctgagagctatctattggcgtgcttagggatgcaagactttgtagccaatatagatgcttacaacgtaaagacactcaaagagagcttccttgaaagtggacgcattgatgcagagtattatttgcctaagtatgaggattacatcaatgcagtatcggcatacactggcggtgtcgctcctcttggtgaggtctgcaccattaaagacagcaactatacgccagaatgtgatatgaagtatcgctacattgagttggctaatattggcaagtcgggcgacattacaggctgtttgtacgaaaatggtgaagacctgcccacacgtgcaaggcgtatcgtaacccaaggcgatgttattgtttcatctatagaggggtctttga

SEQ ID NO: 38533 - DNA, 575 bp, Neisseria meningitidis
atcgagtggttgcaggtggaaatacacgtttcgcctctgttcggaatggattgcaggttgtccctgatggtgttttggttgctgttcatgacggggtacgtcctttggtcagtgctgaaactatcgatgcctgtttcgatcttgcagagttgaagggggctgtcgctccttgtcgccctatgaccgaatcgcttcgctattatgccactgatggcaattatgcagtggacaggagtcggtacgtcacggtacaaactccacagacctttcggagcgaatggcttcgagaggcctatcggcaaccctatgaagagtattttaccgatgattgttcggtatatgaacaccattttggccgaccggtggcattgattgtcggtaatatcgaaaatatcaaattgactactcctctcgatctatcccttgccaaactgttattgacatcctaatacctaaaaaacataagttacatctccacattgtggaagaatacaagacaaacttaatcgaagacctcgaaaagggctagggcaactaacgccatgccaagttttagaactaacttagctactcaa

SEQ ID NO: 38534 - DNA, 600 bp, Neisseria meningitidis
ggcgtttcatcatctcatgtgccctcgatgtaagcacagtgtatataccaccctgcttattgcaaacctcccagctcgtctccagcaagagggaagggttggggcgaaaatcattcattcgatcgcaattcgtttgggaaagttttttccggtcttatcctccgaccaaccgccatacaaaggccacggctacggtcacaacgaaacctgtggcaagcggaatcaaggctgccagcagcgtccatttccggctccccgtctctttatatatgttaaacagggtggtgctgcaaggattgtggagtaggcagaacagcatgagattgatacctgtcagcatagtccaaccgccggcttcgaacagtcgtgccgtttcggctgtgccatcggcttcgaacatgacgccggcaccggttcctccatctattcccgtagtcaggacagtcagcatcagtatcgtcggtatcactatttcattggccggaatggccaatacataggccagcagaatgacaccgttgagtcccatcagccaaccgggtccgtccagcaggtcgatcagatattcggctatcccgactccaccgatttggatgttgc

SEQ ID NO: 38535 - DNA, 594 bp, Neisseria meningitidis
gacggacgtatcattttcataggccccctgctaacggagcaggaagacttacccaccgattttgagaatacagtccctgccatcttggaggactggcatcgtgatgcagcaccctcgctggacttgcgatatgtgtgcggcagctggcgaactcccggttctccccctgtagtactggtggacttcgaacccctccatgcacagaaagcaacgctctactatgagatgtgggagcacttcggcatccaaagcgacaaggggtacggcgactatgacgaggcctcgctcttcggcattgccgcagcccaaacgatgcatagcctgtgtgaatacctctgccccgaagaccaaccggccataggtatattcaacgaatggatgctcggcatgggactcctctacagcaagcggaaaacacctcgtctgaaaacccttttcctcacacatgccaccaccacagggcggtctatcgccggcaataacaaagctctgtatgcctacatgccgggctacaacggcgatcaaatggctgccgaactcggtgtagaagccaaacacgggatagaaaaagcggcggctcaccaatcggacacc

SEQ ID NO: 38536 - DNA, 535 bp, Neisseria meningitidis
gacttcacggttgttttcgaagaaacgcctaacggaataaataagggcggagcaagattcggtctttccacggaagccaatggcgccaaacctcaaagtgtatggatcgagcgtacggtagatttgcctgcaggcacgaagtatgttgctttccgtcactacaattgctcggatttgaactacattcttttggatgatattcagttcaccatgggtggcagccccaccccgaccgattatacctacacggtgtatcgtgatggtacgaagatcaaggaaggtttgaccgaaacgaccttcgaagaagacggcgtagctacgggcaatcatgagtattgcgtggaagtgaagtacacagccggcgtatctccgaagaaatgtgtaaacgtaactgttaattcgacacagttcaatcctgtacagaacctgacggcagaacaagctcctaacagcatggatgcaatccttaaatggaatgcaccggcatctaaacgtgcggaagttctgaacgaagacttcgaaaatggtattcctg

SEQ ID NO: 38537 - DNA, 258 bp, Neisseria meningitidis
ggccgatagatttctgcggatgaataagaccgagtgcctttcgcgaatttgcggtaatgcccattcccagaatttcaccggcaccatttcggccatgtcacagcggcatccatcgattcctttgcttgcccaaaagagcagaatatctcgcatccgaatccacgtgtccggtagaggatcgaagtgtttgcttcctccattcaggtacacgatgccgtacttcaatttcaccgtttcgtaccaatcctccttatcgat

SEQ ID NO: 38538 - DNA, 436 bp, Neisseria meningitidis
gagtaagaacaaccggtcgagtagctgctgcccactatccgggcggctaaaaagcagatcggtcagttcatcgccccaaagtctttcctccggtacgtagtactgcttgggtacctccctattccagaggagatcacgcgaatgatctgtcaataagggagtgagaagaacactattgagcaagtcaagaacagcatctgtccgaaaatgaggaactttttgaataagacggatttctgcctgtaccctgatccacttctcgacaaaaatggaaatggcactttgagagagagggatagcccatagtcacattgatacgtcctacagtctcggccagactgttcaatacgggcatcaacattcctgtatcgggaagaatgatagctgtttctattccttctttggtcagaatagccttcagggtataactcctcga

SEQ ID NO: 38539 - DNA, 521 bp, Neisseria meningitidis
cactttcaatactcaattcattctggcctggctgttgatctttttgggtattgtcctgtttggacggttggggctgctgctgtccgccctggttattgttattcggattgttttgccgttgttttttgtcgtgattactctccttattctgatcctgattgtctcctcctccttgctgttgctgtttctgaagcaacttcatggtcaaagccagattgtaacgagtctcttcatcggtcgggttgattcggagcgaatgcttataggcctccacactctgccgatagtctttctttttcataaaggagttgccgagattgtgcatcagttcggctctacgcttaggtgtcaatgtcgggtcttgtacaagagcagcatagttttggagagcttcatcggtgcggccttgtgcatactgtgtaccggccaaaccgaatcgtgcctcggtgaaagtactgtccttggagagagctttgcgatatgcgacctcggcattggcatattgatggcgtcgatatact

SEQ ID NO: 38540 - DNA, 538 bp, Neisseria meningitidis;
gggactgctttccgacttgaaaaagaaagcaaagaggatggcgatgaccaatgcataagctgcgaaaatataccataccgtgctccaagccgtatgaccggcatccgtaaagcgatctaccacccaaccgctggcaaatccgccgatgatagctccgataccattggtcattatcataaaaaggccttgagcagctgcccgaatcgatggtgtagtctctcgatcgacaaacatggaaccgctgatattgaagaaatcgaaggccataccatatacgatcatcgacagaacgaggaaaatgaagccgctacccggattgccgagaccaaagaaagcgaaacgcaacacccaagccaacatactcataagcatcacccgtttgatcccgaagcgccccatgaaaaacggaatggtcaaaatgaaaagagtctcggaaatctgcgacaaagaaagcaacacattggggtgctgaacggcaaagctctcgctataagcatccgcaaaatgagacaaaaacggattgccgaatgtattggtg

SEQ ID NO: 38541 - DNA, 524 bp, Neisseria meningitidis
gtctgcggcaggtatgccaacaggattgcccgcggttctttctccatagacggcagatgctacagcctgccgatcaacaatgggccgaactctctgcatggcggcatcagcggatttaatacgaaggtctgggaggtgaaatccgccggcccctcttcgcttgtgctggaatacgtgtcggcagatggagaggaggggtatccgggcgagctggtcgttcggatcatttacagcgtcacggatgagggcgcattgcacatagactatcgtgctactgcggatgctcctacggttctgaatctgaccaatcactcctatttcaatctctcgggtgcaggcgatccctccgtgcatgatcataccctcatgatacaagcccggcattatctccccacagacgatacggccatcccttacggcgagcctgccgaggtcgaggggacgccgttcgatttcctcacgcctcacggcataggggatcggatcgacagtgcgatggatcagctcatttgggcaaagggata

SEQ ID NO: 38542 - DNA, 398 bp, Neisseria meningitidis
ctctcctatcgtcagtccatgaagaataggcagcggatccactccgacaaacgaacggcaatcatcttgtaagatgggaccatccacgtagtcgttcgggttcggccgatcagtaacgatcagctttttctgctcctcggcacaagcctccatcacatagtgcagcgtactgatataagtaaagaagcgagtcccgacatcctgcatatcgaatagcagcacatcgacgtcggccaacattcgaggagtaggtttcttgtttttgccgtagagcgaaacgatagggattcccgtcctgacatcccgttcatccttgaccgttgccccggcatcggcatctccacggcagacgtgttcaggacctaggatcttgcagacattgcatcactgccgaggca

SEQ ID NO: 38543 - DNA, 606 bp, Neisseria meningitidis
ccccccgctttctctacataaaattacattttgccgatatttgccgaattgtctgaaaatatgtgtaataaggggcgtataatcaaaacatttgccccggattgccatgccttatttcgccctgtttgacgatgccgtaagcggccgcgcaaaacgctatcaaaatcatgtggaaagccgttttttccgtcccgaagaactcgatgctttggacggcgcgctgcaatcgggctggcaaaaagggctgcattcggtgttgtttgcagactacggattcggtttgccgctgacgggggttgagtccgaacgcggcggcaatcttgccctgcactggtttgccaactgcgccgacatcgatgccgaaagcyggcttgcccgacactcagatagcctcatgcgtgggccatcgacatgcatgagttaagcgtatcgctagcgttcatcctgagccaggatcaaactctccactgtcatatttgtgtttgtttgcttctgtttttctcgctcagacgccgattattaccctttggataattcgatttatcaggtagtacacctcggtttctttttctctctcggtcttttcgtttttcctctttgacaaag

SEQ ID NO: 38544 - DNA, 255 bp, Neisseria meningitidis
gctggttcaggctctcgcccattgaccaatattcctcactgctgcctcccgtaggagtctggtccgtgtctcagtaccagtgtgggggataaacctctcagttcccctacccatcgtcgccttggtgagccgttacctcaccaacaagctaatgggacgcatgcctatcttacagctataaatatttccttgtaatatcatgcaataatataagtgtatgcggttttagtccgtctttcagccggttatccccct

SEQ ID NO: 38545 - DNA, 400 bp, Neisseria meningitidis
  misc_feature (284)..(284): N is any nucleotide
gccgactgccacggtgccggctgtcgggtgacgatcggccgggccgaagtcgggatgccagtcggcttcgtgtatcttctctgccatgccttcgaactcgcctttgcggatcttggccaggttttcacggtggggagcggtagccgatttctcatagaggaatacgggcacgccgtacttctcgcctatcgtgcggcctacctccttggcgagggtgtcggcgtcttcggcagtcacattcttgatggggataaaggggatcacgtccactgcgcccatacggnggtgctgacccgtgtgtttggtcaggtcgatcagctctacggctatgccaacggcttcgagcactgcctcccgaaggggctcgggttcgcccactacggtcacgacgagacggttg

SEQ ID NO: 38546 - DNA, 433 bp, Neisseria meningitidis
cccttcgtgaggaaaagaccggtggattccactacgtattccactccgacttgatcccatttcagatcggcagggttcttctcagctgtaactcgaatggctttcccgtttactatcagctgaccatctttgacttcgactgtcccattgaaacgaccgtgtacactgtcgtacttgagcatgtacgccatatattccacatcgatcaggtcgttgatggctacaatttcaatgtcgcttctgttttgtgtttgtgctgcgcggaataccaagcggccgatacggccaaagccgttaatacctactttcgtcataactaagtgcttatattttaatgttaaccattattgttttgtccggaatactttgcttttccccccgaaaaggatccgcagagattcttcccgatagacagcgttccaatgaccttgct

SEQ ID NO: 38547 - DNA, 374 bp, Neisseria meningitidis
  misc_feature (331)..(331): N is any nucleotide
taaatggatgacccggcttttttgttccggtggttgatttctcatcggtttcaaacaagaagaaagagtccgactctctatttacttgtatggattcagagaaaaatcagagaaggccttcgtcagcgaaactgaaatatgccccatcgtcaccgatgatcagatggtcgttcagtcgaaatccgagcaatgtggcagccttttgcaccctttgagtaagctgaatatcctgttcacttgggcgtaccgttcctgaaggatgattgtgtgccagaatgattgccgaggcaagatgagagacggctttgtgcatgatcagacggacatcggncgaagtctccgatacacctcctcggctaaaggttctcatgctg

SEQ ID NO: 38548 - DNA, 403 bp, Neisseria meningitidis
gtacttcgaagaagcatccggcggcacgatctttctggacgaagtgggcgaactgcctttgcccacgcaggcgaggctgctgagggtgctggagacgggcgagttcatccccgtaggagccagccagtcgcagaagacggatgtccgtatcgtagcggcgacgaatgtgaacctcaaggaggcggtagcgaacgggaagttccgggaagacctcttcttccggctcaatacggtaccgatcgaggtgcctgcgctgcgtatgcgaccggacgacgtgcccttgctttttcgccgattcgccgccgacagcgccgagaagtatcggatgcctctgctgcgcctatcggacgaagccgtaccatattaatgcgttaccgctggcccggcaatgtgcgacagctgc

SEQ ID NO: 38549 - DNA, 441 bp, Neisseria meningitidis
  misc_feature (1)..(441): N is any nucleotide
gccattgtggacgaactctaccggcttgccggtatctataatacctgtattatctgtgtactccattttgtcccgaacgggattaaactgcgtgggcatatcggttcggaacttcagcgcaagtcggcggccatcctctccatagagaaagatgagaatccggctttgtcggtcgtaaaagcacttaaagtaagggatggaagcccgttggatgtacctttgatgctgttcggatgggacagggaaaaggaaatgcacgtttaccggggagagaaatctccggaagacanagaaaaacggaaacttacggaattgggacaaatcgcanaagaagtctttcacgcncaagagcatttatcttacaacgaactggtcgaaagaatcatgcanacggtcgacgtcaaagaccgtacggccaagagttatatcagttatatgcga

SEQ ID NO: 38550 - DNA, 360 bp, Neisseria meningitidis
cgtgcatatgtgtcggagaacggcttgcgtcatacccccgaacgatacagcattcttgaagtcgcatataatctgaagaagatattcacgccggacgacttgttcgatctcactcgcgagaatggcttgcctgtaagtctttctacggtctataatacccttaccttgctcgaacgctgcgggatcgttctgcgtttgccttctcccgaaaccaaatatcagtacttgatggcttcatttgcagagcagtgtccgctgcttttctgtaccgaatgtgcacaattttctacctactaccgacgaaatgtgaagtcgatactggccgacaaggatctcagaccaccacgcttctcttatagg

SEQ ID NO: 38551 - DNA, 339 bp, Neisseria meningitidis
gcacacctcctgcgcgataagccttgattatcgcctgacggattttttccggatcgaacgactgcacatgaccatcacgctttacgatgcgaaggattacctcttccattgtaatacgttattgtaaaaaaatacttcctgagatctattctcttagtgccggggagactcctttcctcgaggtcttctctccatactttataggcaactcgtagaggcaggtattctggcttacttcatctcttttctgtttgtcgcgccttcccattcagctccacctctaatagtggagaatgaacagtggcatcatttggaaagcgacaagagtccgcatgtcaa

SEQ ID NO: 38552 - DNA, 375 bp, Neisseria meningitidis
  misc_feature (346)..(346): N is any nucleotide
gtaggcagggggatccccctcaaatcccaaaagtcttgtattggagcgactcagctctcatactaaaaactcccccctctaagcaaacatttaggacactattgatttgatagcggtttttctatacaaacgatgatcccggccccctgcttgaaactgaattttgacacaccctcttctggtagttggggttaatttaggccttgcgtttttttctgcggaaaggttgccgtctttaaccataaagagatgagactttattgaaagagcatatcggacgagatcggcttgaacttttcttctcccttgagccgtatcattaccctgctgtagttccaataagtangccagccaccttgtatggctccgacccat

SEQ ID NO: 38553 - DNA, 438 bp, Neisseria meningitidis
gtatggtttgagtgactacgaggttgaggagtgcatcaacgactccttgcttttcagtgaattccttggcttggacctcggcttcccttcccccgaccatagcacgatcagtcgtttccgtagtgaactcactcgcttggggattatggataaactccttcgggagctgaacaagcagttcaagaagcacggcatcagccgtatcgatcaaggcgccatcgttgatgcgagcattgtggatagtccttacgcccctgatggcaacgtggtcatagaagtggctgaagatcgagaggatactcgttcggaggaagctcgtacacagccaggaggcttatcattgtgaactcaagagtggcaaaccgggagtagactcggaggctcgttgggtacgcaaaggcaggcactatcggtatggatacaagaagcacgtcttga

SEQ ID NO: 38554 - DNA, 272 bp, Neisseria meningitidis
gttttggaatataatatcgaagttccggacagaatagtccgttttaccttcctgtatcggcatagcatccatctctctcacccgatcgatacgtacatcgaggtactgcaagagtagcaaattgctgaatacttcacttatgggattatatatgctcgatccgataagcagaaagactaaataagtgaatagatcaattgttccttctgacaagagataagctcccattatgattacagaggcaagtcccagtttgaggattatatgtgaag

SEQ ID NO: 38555 - DNA, 448 bp, Neisseria meningitidis
  misc_feature (433)..(433): N is any nucleotide
gctcacagctctatgagatggagctacagcgccgacgagctgcagaggccaaagtggaggccggcaagaaaaagatagagtggggatcgcagattcggagctatgtattcgatgatcgccgtgtgaaagaccatcgtaccaactatcagacgagcaatgtcaatgccgttatggatggcgacatagatgaatttatcaaggcttatctgatggaatttgccggtgaagaggcgtaatcgactttcgcttctgaaggaagggattcgttgatcaaaggaaatggggcaggcttgtattggcagtcggcccatttcttttttgtgggaagtccggaaatgtcgccggtttatcggctcatatacaattatacgcagggttattgtatctcatgtcctttcgggtagtaggcactatattcctgctacaggacggngaaatagccgacttt

SEQ ID NO: 38556 - DNA, 391 bp, Neisseria meningitidis
  misc_feature (375)..(375): N is any nucleotide
ctcttcggattagatacggtttgtatgcttctcgataaggaattgcttgactttgcctactctcttcccttcgaataccgctacggaaagcgtatctatgatgatatttgtcgtgaactgtatggcgagaaaggcatttctttttcggacgatttgaacctgcatggcattatctcttctcctgtttaccgactcaaacgatctctaaagcctttgcttcgaccatttataccccgtccttcgatttggaaaggcgatattatcggttttgaacggatcatgcaacctgtattacgacaggtagagcaagacggacgtttccacccgacatctataaatgggttatccttctgctggtatctgcttcaaaacganaaattgattgaccgcc

SEQ ID NO: 38557 - DNA, 330 bp, Neisseria meningitidis
gccaagttcttcagcaggtcaatgccttcggcaaaccatgacggggcattgaacaaactgaaaggcttgatcgtgtaagaaatgtcatcgagtacgggaacgactacgcctgccaccttctttgccgagagcttgacaccctccacactgatcaggtcgggtttgaattcgttccacaggcttaccatgcttcggtagcctacgatctcttcttccagttggcgttccaatcgctccacctcgtccttcgttcgcttcacctccagacgcaatgcgctctccttgcttttgatcgtcggtaaggtacgctctcgcatcttaagctgcttt

SEQ ID NO: 38558 - DNA, 468 bp, Neisseria meningitidis
gcttatggcaatgctgcccaaggaatcatcgacttggccgaacaggcaagtgctaagatcgtcggtatgggctttatcatagagaaagcctttcagaacgggagagaggctctacaggaaagaggtataagagtggagtcgctcgcgatcatccgaagccttgacaactgctgcataactattgcagacgaaaacgaagactaaccatacaccattccaatacacatcccgtccgctggctcagtgggcgggatgttgctttttccttcccttttctccgaatataaagacgtgccacttttcgtttctcattcggaaggcatattgagccctttgaaaaaagagaaggtctctataatgcaagaatccgagtacgtgctacagatatggccgagcggcagtttagagactgtctcctctgtcctcaagataataagtgccacgcaggatttcgcgtttaacgggagg

SEQ ID NO: 38559 - DNA, 373 bp, Neisseria meningitidis
  misc_feature (296)..(296): N is any nucleotide
ccactttttccgtaaggacagtatcgtacgtttccaccgctcggctttccgcctgtccctgccggtgatcggcggcataacggctataggggtagcaccctttcgccatgcaccttacgggcagtctggtcaatatcatcatgaatcgttctttcgtatcctacggcgagacagcagatgctaccgacttggccatcggagcattcgggattatcaatggctatgccatgctctttttcatgattatcatcggtgtggctcaggggatgcagccgatcgtaggtttcaactacggngctaaaaatccgggacgggtgaagtcggcctatcgctacagttgtggcgtcaatctactggtcagctttctcggttt

SEQ ID NO: 38560 - DNA, 416 bp, Neisseria meningitidis
gcagatggcgaacggatttgccagcttgttatcgccagacatgaacaggccgaatgggtgcttacagacgaattggccgatacggaacgaggtgcaggcggatttggtcatacgggcaaagaataattttcaatctcccttcaactaccacagatgcggatccattctatcattctcctgctgtttcttttagttatttctcctgtagccggaagtatatccattacagacagtacagcatctaagttcgaccgatatttctatgaaggtgtccggcagcgagaacaggagaattatgctgcagctttcgacatctttcgctattgccatcggttgaatcccaacgatgcggctctgttatcggagttgggaaaactgtatattgccaatgggcgtcaggaggaaggaacccggta

SEQ ID NO: 38561 - DNA, 231 bp, Neisseria meningitidis
cgattatgagcgctgtgcgtacgcctacgcgccagctctcaagccgccggacaattgaatgcgacgatagtttggattccatcaatgccactaccagcgcgattgtgaaatacgtttcccagcgtgcgggcatcggcatcaatgccggacgtatccgcggtttggacagcgaaatccggggcggcgaagcgcggcataccggctgcattcccttctttaaaatgtttcagg

SEQ ID NO: 38562 - DNA, 328 bp, Neisseria meningitidis
gtccgctgatcgagaacgcgcatgaaaacggtagtctggattgtcgtcctgtttgccgccgccgtcggactggcgctggcttcgggcatttacaccggcgacgtgtatatcctactcggacagaccatgctcagaatcaacctgcacgcctttgtgttaggttcgctgattgccgtcgtggtgtggtatttcttgtttagattcattatccgcgtattcaatatccccgaaaagatgcagcgtttcggttcggcgcgtaaaggacgcaaggccgcccttgccttgaacaatgcgggtttggcgtattttgaatggcgttttgaaaaag

SEQ ID NO: 38563 - DNA, 543 bp, Neisseria meningitidis
cgcgactgttgcgataagcgcggaggcgatgatttttttcatgtgtgtcctgtttgggtggaaaatcggttttattgtatcgccgtcgggaattttggcaagcattctgccggcaaatcgtgatgtttacaggggcagggtgtgcaatttgcggacaaatgcgaggctgttggcgactgggttgcctttgttttcgacttcgtgttcggtttctacggtcagcaggcggcggtttttgtgtttgttcaggctcaattcggcttgtgcgggtgtgaaaaacaggcggtgtttttcggcaaagcggcgggcgcggctgttggcggttttcaaaatctgaagcagcgatcgtccagatggaagcgtcgcacgcccaatacgagaatccgtgcggcaaaaaaatcggcggcatcggtaaactcggcggggctgctgcggctgaagtcgtgccgttcggcggctatcaaggcggcaacggtgcggatttgcggaatcatcgattcgctgataagtgtgtcgtcccgccctgcatcgagaagcatgggg

SEQ ID NO: 38564 - DNA, 448 bp, Neisseria meningitidis
acttcttaaggtcaaacatctactactgattgacagcgaattagcattgcgagggaaaggtgaaaagaattttgggaggggagcgaaatagaattcgaaattcgacgtacataaatagcgggagtgtttcagcggcgcgatcgtgcattccccgcacaacgggctaatgatccatacctagcagtgagtccaattgaacaggggaggtgcagggaaattgagctccaacagggtgacgagccgtcgggcgcagatttgaaattgagcgactcacttacggttaggccgaaggcgttgcaataggcatcggaggattgaatttatgtacgccgtaaaacgtggggacgagtcgcggacaggggcgaaaggtcaaataaatctggagacagtcggcctcttttgaaaatcacccaggcagcgttctgagtaagatatcgacgggggcaaa

SEQ ID NO: 38565 - DNA, 418 bp, Neisseria meningitidis
attactgcccaagtggaagtgggcaaagtgtacgaaggcactgtggtgcaaaatcctcgataacaatgtcggcgcgattgtcagcgtgatgccgggcaaagacggtttggtacacatcagccaaatcgcccacgagcgcgtacgcaatgtcggcgactacctgcaagtcggtcaggtggtgaacgtgaaagcattggaagtggacgacagaggccgtgtccgtctgtccatcaaagccctgctggacgcgcctgcccgtgaggaaaatgccgccgaataacgcttaaggtgaaagtgccgtctgaacaggtttcagacggtattttttacgggtatcgggaatgaatggggcttacagccacaggacggcaagtttccataatgcccggggatcctctagagtcgacctgcaagcatg

SEQ ID NO: 38566 - DNA, 666 bp, Neisseria meningitidis
aggtgtacacggttcccgccattagtactatgtggtcgtggttccggcccccgaatgacatcctgttgacgataaacctgctggtccggcaccgtgtggtaattcgtgtgcaccctagattgataaagttgacccgtggatcggcaaatattatgttgacggcgtcgtgttgtaaattgttgttgacacctgggcagtggtttgtgccactgttggtaactccgttccggctggagtcctacgtagtagaggtagccggccggatgtactgttcgtgacgaagacacgtggaacatcggctcgtacggctagtgggctggtaataggcatgttgtgtgtactccccctgacaccgacaccccttaaattgacaccgctaatgcctggatggtggtttatggtcgttagtacacacctggtaataaacatgttccccctgttacttcgtctttaacggatcctcataccgttgctcgtactgagcccgattctggccccagtacttagacgtagccctaacctcctgttgaatatggtgcctgttctgctcgaaatgatggggctggaaacgttgttgacgaccttgtttaaattgaaaaccctaatccctatgtttaaatggcgtaacgttcgatttaagcctaaattgacaatatttggtttgaa

SEQ ID NO: 38567 - DNA, 487 bp, Neisseria meningitidis
ggtaacgcctaaaggcgaaacccaactggacgccgtgaagaaaaactgctgcgcgccatcttcggtgaaaaagcatctgacgtaaaagatacttcattgcgtatgcctaccggcatgagcggtaccgttatcgacgttcaagtcttcactcgtgaaggtattcaacgcgacaaacgtgctcaatccgcccggatgggatttgatgcgttgcggggaattgatggggccggggacgaggacgttggcgcgcaggttgccgaagcgttcccattcgtcggcggcgactttgcacaggtagttcaacgcggctttggacgcgccgaagccgccccagtaggctttgggtgtttcgccgtggctttcgccgacgaagatgacggacgcgtcgggcgactgcttcagcagcgggaacagggcgcgggtcagccccataggtgcgacggtgttgatgcggtattgggtgacccattcggcgacggtttggaaa

SEQ ID NO: 38568 - DNA, 595 bp, Neisseria meningitidis
gttccccttgtaggtcgcaaccgaaccctataaattgttgaatatcgttgatggatgtgtgattagtactaggaatgttgtaactgttaaggtccttgttgtttcgcttaatatgccggtaggagaaattagtagtaaaggtacctttaaatgcgtggataaagcggctgaaattatgtctagaaataatagcgtgttatttggtaggaatagatcgtttacttaacttatgtcaatgacctctttccaaaacctacgaaaccaaaactgaaagatcgcaatatggcacccctcccctatgaaatcccatcctatgcttgttatagtgcctagatggtaccccttcgccctacgttgttcgaaattgtttaaacttgtgcctcttcacacaacgctggatcccgtgttgtaccctaggacctcccaacggtacccgttctatcacccatttcgttggatgatactattgttgccccggatgacgccgtttcgacgattaaagttgttgtaaagaaaattgttggtgcggctggtgatgacccggtatttaacgttaattgggccatgggtgcactggtagaatgtgagccgttga

SEQ ID NO: 38569 - DNA, 622 bp, Neisseria meningitidis
cgcgccgaagaaattcgccggggccgcggatgttgaggtcttggcgggcgatttcaaagccgtcggtgtgttcgtagatgactttcagccgcgctttggcgagttcgcccaagggtcgccgccatttcgacggggtggtgtccgtagtcgtccaccaagagcgcggtcccgccgtttggcaacttgatgtcgccgtatttttggaagcggcggccgacgccttcaaagccgagcaagcctttttggatcgcttcaaccgatgcgccgacttccagcgccacgccgatggctgccaatgcgttcagcacgttgtgtctgccgggcatattcagcacgacttcaaacgacccctgctcatgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagtttttcgacgctgtgcccgtaggtatccatatggtcttcgtcgatattgg

SEQ ID NO: 38570 - DNA, 360 bp, Neisseria meningitidis
tttgacggtttcattatggcgcagcagcttcccgagccgctggcttcgcagtttgccgcgatgaatcggggcgacgttacccgcggggctgattgaaaacggcggcgatgctgtctaaacaaaatctccgtctgaacaaaatccccatcggataaaaaatgccgtctgaaacgtttcgggtttcagacggcattttgtcggggtacgcggcggtgcggcttatttcactttacctttcaacgcgccatatcctgccgcgtccatttgttccagcgggatgaatttcaagctcacgccgttgatgcagtacagcagtccgcctttgtcacgcgggccgtctgggaagacatgtcccaaatg

SEQ ID NO: 38571 - DNA, 342 bp, Neisseria meningitidis
cccgtacagcccgtcaaaatccgtcgcgttgttgtcgggcagtaacacgcagagagacgttcagacggcgtcgcccgtttcccaaaaaacgccgtttaaagtaaaaaaatattttaaaacagacagttgatattgacaaattcaaaccgaagattttaaaatgctgccaacccaatccaaaccaaccgacaaactttgggcgtggatgccggcatccccgtattcgccctgctgcccggcagacgcgtcagcgagatcgactatatggcgccggtgttttttcagacggcattattgttgttggaacgctatcccgccgcactcttcctgctgcctgccgca

SEQ ID NO: 38572 - DNA, 286 bp, Neisseria meningitidis
cacttttatataaatcattgatcccattaccccaacctccaattttttgccaaccatctattgtatattcaacacctaactttgttacatccattatcacagattgtaaaaaagtaaaatgcttctctttaaaagatccatcaaatcctttatctaaagcagatattaactgctttccattatccctttcgctaccgttcggattatttactgcttgctccgcctaaaaaacgtcgtatttaatattggagtgatttgacacatggcacgttatattggtcctaaa

SEQ ID NO: 38573 - DNA, 448 bp, Neisseria meningitidis
  misc_feature (1)..(448): N is any nucleotide
gagtttggctgtaactggttttaccattatggcggcacgcgtaaacatttgccgaaaatacggtctgaaccgctgtaacaagcaacatacttccaattattttagatacgcgcatatcaacctcctttatcgttcatcttcaaaaaagggaaagtttttcaatagcacttcaatcaattccttcattccccggccaaaaattggacggtaattcccacccaccccctactttgatttcagaaatatctttaaacttccgcttaaaggcggacactttgtccatatcgtcatcaatttcctgtttgccgaacggtattttccgcttttccaaaacctcgtcataataacaagatanattaagcaatagcccccaagcactatttgcaattacgactaatctatgtttttccctagttaagtaatctgcnacgctatcatagattgccct

SEQ ID NO: 38574 - DNA, 778 bp, Neisseria meningitidis
ccttgaaatgaagtatctctcttataaaactatcttggtagctctatagtgttcgtgacccagtggagctccaagcacatctgtggaaggtaattcttcacagacactgtgggatttcattgctgcttttgggttgtgactcagctccttcggtaaatatagcccattacatactttctccaagagctgaattatagtaattcaatttttaaactcacaaaacattttgtcacagaaattaacccaaaggctttaaattatatcatttcttgatagatcacttatatttctattttcttgatttcttactggattttaaaaatagtcccctttggtctttcacatgatcttatttaagcccctttcccctagtgtgactttctttacaataaagttattgggaaaaactcattaattcattgacagaaggtattgaactcctgggtgtttgaacagatatacaacacgctgaagctgaattgcgccgtgtatcctgctgtggacaaatcctgccgcgcgtcggcggacaaaccgtattcctacgacagcagcgaccgtttccactaccgcgaacagcacaatgttttgaatgcctcgtttgagaaatcgctgaaaaacaaatggacgaaacaccatctgactttgggcttcggttacgatgcttccaaagcgatttcccgccccgaacagctttcccacaatgcggcaaggatttcggaatccacgggattcgatgaaaacaatcaagataagtatcttttgggtaagcccgaagtcg

SEQ ID NO: 38575 - DNA, 538 bp, Neisseria meningitidis
ccccaatcgaccgacccaaaacaaatcaccccctgatgtaagccgtagtaacctcgttgtacgccgttgtgctgcactggcaacgatcctcttgtttaatacatgggtaattctcctgacttgccggaccctacttaacacatcgaccctgtcgatggcccgtctctttctgtcgcgtccgtgtatttgttagcggcccctcttgtaagacgtgatccggggaaggcgggcaaccgtaagtattcgacgcccctcgtttaatgtatgcaacgttccgttgattaccctagttatctttttcttaacattggcactgattctactaaaaactaaggcgggaatccgggcacaccggtcggtaataattcgcaaggtaaggtcgacatgtgttaacctgttgttggaggtaatcccacctagtagatggggtggaccgttcccgccggtggtaatccgaaaccgaattcgtcttaaattgcgcgttgctggtgatgaaggtaataggatgacgctcaaatgtgtgttccctacggtaagg

SEQ ID NO: 38576 - DNA, 636 bp, Neisseria meningitidis
  misc_feature (373)..(373): N is any nucleotide
cttcgccgccgcgtccgaacacgaaagggtctccgcctttcaaacgcaccacgcgcctgccttcgcgggccagcctgaccataagcgcattggtgtcctcttgcggggtgcgctcgccccgggcgcgcttgccgacaaaaatccgttccgcatcgcggcggacgagggacagtatgccgtctgaaaccagcgcgtcgtaaagcaccacgtctgcctgctggatttcctgcagccctttgagcgtcagcagccccgcatcgccgggacccgcgccgaccagcgagacggagccgccttgatcattttgacgactttgttccaattggcctgccaattcccgttcggcaagggtgttttgccggtttttgacganggcggcgaaacgtccgttaaactgcttttcccaaaagcggcggcgttcggtaacggatttcagtttgcccttgacggcatcgcgccaccttcctgaaatttccgccatatcgcccaaagacggcggcagcagggctttcagcctttcacgcagcagtcgggcgatgacgggcgccgccgaacattacctgcctctacatccgtcaggcggaagcactgggcttgggacacgccgtcttgtgcgcccgcgccgccatcggagac

SEQ ID NO: 38577 - DNA, 412 bp, Neisseria meningitidis
  misc_feature (265)..(265): N is any nucleotide
gtccccctggaggggggcgggctcttcgttgcggcggaggttgtggtcttcttcgggctgcgcctgttttttgcggagcgctgcggccggcccgcgccgtttttcttcggcttgcgccttttttgcgtttctgggtttgccttcggcgggctgcctttccgggtccgggccttcgcgttgcggtttttgcggttcgtcctggcgggcggagggttcgctgtccggcgttttttgggtcttgcgcgcctgcttgggttcggggtgngtgcgctcggtgttggtggggccggttttttggaaggtgtcggcgtgcgcgcctgcggtgcggcgcgggccggtcggggccgcggcgaacgcgcgggtcgaacgggtcgtggtaaggctccttcgggtgttgccgcgaagtgccgtc

SEQ ID NO: 38578 - DNA, 156 bp, Neisseria meningitidis
  misc_feature (67)..(67): N is any nucleotide
  misc_feature (70)..(70): N is any nucleotide
atcaaataattgattttattagaatctatttgcaaagccatttgccgttacacaagaatggcacatntcnataactgatgaggatttataccgatgaagacagacattcaaaccgaattaacccatgccctactaccacacggattatctgtgggc

SEQ ID NO: 38579 - DNA, 308 bp, Neisseria meningitidis
cgtgtccgcgctttcgcccgacgatttgccgctcaaccaaaaatggtcgtgggacaaaatcctgcgttcgccctttatcaaacaggcggacgtattgcaaggcatctacttcttcagcgaccgtttcaatatcgacgaaaaacgccgcaacttcgacttctacgaaccgatgaccgtgcatgaaagctcgctgtcgccctgtattcactctattctcgccgccgaactgggcatagaagaaaaagcgtggaaatgtacagcgcacgcccgctggactggacactacacaacgacacgaagaggctgca

SEQ ID NO: 38580 - DNA, 106 bp, Neisseria meningitidis
aggatccccgccgcttcggtacgcgccctggaaatgttggcatggctgccggggaaactcggtttccctgtccccgatgcgcgggcggtcatcgaaggccgtctga

SEQ ID NO: 38581 - DNA, 554 bp, Neisseria meningitidis
acggacaaagcgtgatggtcgtcgggcatcagaaagggcgcgacaccaaagaaaaaatccgccgcaacttcggtatgccccgtcctgaaggctaccgcaaagccctgcgcctgatgaagacggcagaaaaattcggcttgcccgtaatgacctttatcgatacgccgggcgcgtatcccggcatcggcgcggaagaacgcgggcagtcggaagccatcggcaaaaacctgtacgaactgacgcgcctgcgcgttcctgttttgtgtaccgtcatcggcgaaggcggttcaggcggtgcgttggcggtcgccctaggcgattacgtcaatatgctgcaatactcgacctattctgttatctcccccgaaggctgcgcgtctattttgtggaaaaccgccgaaaaggcggcggatgcggctcaggctttgggcattactgctgaccgcctgcaaaagctggacttggtcgataccgtcatcaaagaccattgggcggcgcgcatcggggattcgggcaaagaccgcaaaaactcgtggacatcatcgccgctttag

SEQ ID NO: 38582 - DNA, 606 bp, Neisseria meningitidis
tagcaattattgtttcgaaataaggtgatattgccatcccggctggccctggcatccctcatgcgggtgaatgcgtggaatgttaaggttgtaattttaaaattggtgagttctcgattaccgttgttgttaaaatgttcaaaccttgtgttggtaaagtcccgaaagatgtatcgcaagttgccccccacgaaaaaagttgacctcccaaagaactggtccccccactggcttataccacctcgaccctaaactggtaatatatcgtccgctatgcgtcctaaaggtacccgtgttgttgagtaggctaagtcgcctccgcgtgttgagcccgttgaaggactcaactcgccctctgtctaactcgcttaaaggtcgtctttatacatacccgtagcagctgatggtgaggtgggcaccgcccgaactcaaattgtgggtttgtaaactgccccgttaccccctggtaaatggaacacctcctatgtaagatctgataacccctcgccccgttcgtggcccggatactgtgtaccgggagagtagggtggccaaagtgagtaatgttaaaacgatttatgtttaaacgtggacggcgtggacccc

SEQ ID NO: 38583 - DNA, 677 bp, Neisseria meningitidis
gcggcaaatccacctacatgcgccaagtcgcgctgattgttttattggcacacaccggctgttttgtgcctgccgttcagcatatcggaaaacttttggtattgtggcgtaagaatatcgaagcctgacagcctgaagcagttgttttgctattgttctttaacgggcgggacgccgtccttcggcgcggcatttcggcgggccgaaaccctttccggtgaaaacggattttgattgccgcccgatgctgtctgcaagttgcggcggcttccgtatggtttgaattgttgacaggatgattggagggcttatgcagtttccttaccgcaatgttccggcttcgcgtatgcgccgtatgcgcagggacgatttttcacgccgcctgatgcgcgaacacacgctgaccgccgatgatttgatttatccggtgttcgtattggaggggtcggcgcgcgaggaggatgtgccttctatgccgggtgtgaagcgtcaaagtttggacaggctgctgtttacggcggaagaggcggtaaagctcggtattccgatgttggcactgttccccgtggttacggcaaacaaaaccgagcgtgcgcaggaggcgtacaatcccgaaggactcgtgccgtcaactgtccgcgccttgcgcgagaggtttcccgaactgggcattatga

SEQ ID NO: 38584 - DNA, 517 bp, Neisseria meningitidis
  misc_feature (425)..(425): N is any nucleotide
gggtatgcatgtttgattccgcttctttcagccacgtgcggaagccccagcgtttgaaatcgacaaccagctgcgcccatttcggcgtagtacggcgcaggctttcgatgccgtctgaaagctcggcgtgcaagtccacatcggttttaatcgtgaccaaatcatacgacagcggcagttggggcagcgcggcttgcaggttttcgcccactttgcccttgatttccgaagcgtgttccatcacaccagccagcgaaccgtaggcttccagccatttcaccgccgttttcgggcccgggcaatttcgagctgaacgtctatatgcccgttatcgcctacaacctcttgcaatccatccacctgttgggcgacgcgtgcaacagcttcaacgaacactgcgccatcggcatcgaactcgtgccggnaaaaatcgactatttcctgcaccattccctgatgctggttaccgcattataccgtaaaatcggttacgaaaacccgccaaagtcgccaaaac

SEQ ID NO: 38585 - DNA, 489 bp, Neisseria meningitidis
aggttggcttgtgttcataaaaaacttattacatgtaacggtttgaacggacattccgtcgggtcggaatgtcaaaaaggcgcgattgtaccaaagaagttggacataattttgtttgcaggctgaagatttgcttaaaaattcattaagatgggcggaacaaatagtttgggtacagcgtgttgaaataccgcttatcccttaaaatagcgtccgaaattctgttcggacggcatcaagacacacggtaatccgtctgaaccccccatttgacatcaacaaacaagagcattgaatgaaattcatcgacgaagcaaaaatcgaagtcgccgcaggcaaaagcggtaatggcgcaaccagtttccgccgcgaaaaattcgtaccgcgcggaggtccggaccgcggcgacagcggcaaaggctgcagcgtctgggcagaagccgaagatcacaccaataccctcgtcgaataccgcttcgttaaacgcta

SEQ ID NO: 38586 - DNA, 609 bp, Neisseria meningitidis
ggtaactgacggatcgggcattccttaaattacccgtgtatcgctgtaaatcttagagatggcggaatatagcggactgcatcaccgcccgccccgattcaaccatggcgcgccatgccgacatccacatcacggcgtcggtttccaaagaagcctgcccgctggggcttgccccgaccaccagcaccaccgccgtcatggctttgggcgatgcgttggcggtcgtcctgctgcgcgcacgcgcgttcacgcccgacgatttcgccttgagccatcctgccggcagcctcggcaaacgcctacttttgcgcgttgccgacattatgcacaaaggcggcggcctgcctgccgtccgactcggcacgcccttgaaagaagccatcgtcagcatgagtgaaaaagggctgggcatgttggcggtaacggacgggcaaggccgtctgaaaggcgtattcaccgacggcgatttgcgccgcctgtttcaagaatgcgacaattttaccggtctttcgatagacgaagtcatgcatacgcatcctaaaaccatctccgccgaacgtctcgccaccgaagccctgaaagtcatgcatgcaaaccatgtgaacgggc

SEQ ID NO: 38587 - DNA, 289 bp, Neisseria meningitidis
tttttcacacgcagtccgaaacgtcagacggagtttgcggtcggacaggtaaaatggtggcgtgcttattgaaatttcgacaaaggtcgtctgaaaaccgaaaatatggatttcagaccacctttgttgtatttggtaagtatatgttcccgttgtataattacggaattgcaattcaatacaaaatacacaggacacgccatgacagaatccatcacatgagacagtacacaatacgatgtcatgactgtaggcgcaggcccgtcaggtttgtctgccgccatcacac

SEQ ID NO: 38588 - DNA, 1143 bp, Neisseria meningitidis
acaccgtcttgttcggcggtatgaatatggacaaacagaccgccgacctgcgtgccggctgcgaaatcgtcgtcgccaccgtcggacggctgctcgaccacgtgaaacagaaaaacatccatttgaacaaagtcgaaatcgtcgttttggacgaagccgaccgtatgctggatatgggttttatcgacgacatccgcaaaatcatgcagatgctgccccgccaacgccaaaccctgctcttttccgccaccttctccgccccgatacgcaaactggcgcaagacttcatgaacgcgcccgaaaccgtcgaagtcgccgcgcaaaaccggcatcgcaactccaaagagaaagaacccaaaccgtcattcccgcgaaaaatagaaaatcaaaaaaaaaacctaaaatccgtcattcccgcgcaggcgggaatccaatccgtccggtttccgttttttttttgaatttcaggtaacttccaaaccgtcattcccgcgaaagcgggaatctagaaactcaaagctgcaagaatttatcaaaaatgactgaagctcaaaaaaccggattcctacgaaaacaggaatccggagtctcagggctggcaaaaccgttttacccgataagtttccgtaccgacagacctagattcccgccttcgcgggaatgacgaaattttagattgcaggcatttatcggataaaacagaaattaagcgtgacgaaaatttatccgaaatcacagcaacttttccgcgtcattcccgcaaaagcgggaatctagaaactcaaagctgcaagaatttatcaaaaatgactgaaactcaaaaaaccggattcccgcgaaaacaggaatccggagtctcaggtttggaaaaaccgtttttcccgataagtttccgtaccgacagacctagattcccgccttcgcgggaatgacgaaattttaggcttctgttttgattttttgtttttgcgggaatgacgaaattttagattgcaggcatttatcggataaaacagaaattaagcgtgacgaaaatttatccgaaatcacagcaacttttccgcgtcattcccgcaaaagcgggaatctagaaactcaaagctgcaagaatttatcaaaaatgactgaaactcaaataaaccg

SEQ ID NO: 38589 - DNA, 465 bp, Neisseria meningitidis
gtgccaacaaaggcgaacccccggaatgaggccgataccaatattctgaaaaacgtcgaatctgccttgcaagacgcggacattaccgtcggcaacctcgaaggcacgctgtttgacgaaggcggtacgccggagaaaatgtgcaaacccccaaaatatgctatgcattccgaacgccctccgcatacgggcaataccttgccgacgcgggattcgactacctcagcttcgccaacaaccacagcaacgacttcggcgcgcaaggcatcacggcaacggcggcgagcggcagctcttttacatactcgatcgcgctaaagccgctgccgataacgatgccaaaattgcgggaaataccgccatcgcccagataaatttgtccatcatcagacctttactgttcagacgagacagcatttgccgcacgttttggggcttatctttcgatttgcgctacgtcgcgca

SEQ ID NO: 38590 - DNA, 578 bp, Neisseria meningitidis
gttccgtccttgattcgattggtcgatagtctaatactacgatccttgttgaggtagatgaatgtaacgtggtagaagacgttgttacttgttgttcgcccacggactatccgaatgcggatgaagaaattgttgatgcatcggcctaggaaggccccgtaattccggaagaagctgttcacgccttcgttgttgaatcgtccgttaccgaaggacccgatgaagaaactgctgacacgtcttgtaattgtgtttgtgacgttacttcgattacggtgaccgttgttgaagaaaaatcgggtgaagcgcttgatgacacgtgtaattctgaaggtacagacgttgacacgtcttgtagttccgttgaagtacgtaccattatttgtgatgatccggtagagtccgtcgcggatgaatcgaccgaaactattggcgcaaatgaagaaattgtaaaagttgctacttcgattgtatgtgaatatcggcccattgaagataaacaaagggggcatagacgagcaatataattgcagaataacccgttgttgagtcgaaatgttttgctgaagattcgccga

SEQ ID NO: 38591 - DNA, 605 bp, Neisseria meningitidis
aaaatttggacctctcctcaagtgaactccgttcctatctaagtcctccttgtactccccctagcccattgacaagcgcgaacgttcaaagttctcctccctctcagaaaggaggcgacttagttgtaggccttttcatggtcattccgccatgatcctattttagctacgaagtacattgcggcaagtggatcttccgcggccacttcattcatcctcggcactttttatctttacggcgcgatgggtggcgcgcataagatttgggaatgcacctattgtagcacgtcgattcgtgaccatcagtgaccttgatcctacgtatctgagccgtagagcgtaacttggatcatgactggccccgcgagaccggtcttgttctgtggtccggtcatttctcgcattgattaccgcacgatgcgcgaagtttcggctacaagggttacgaggatccgatgctacttttattccttcttggtccgctattggtagctctaccagagcgtttaatcgaacgacggtaatcaacgataagggccgtgtctgccgtgggatccaatttaatactctatgatatgagtcgatgatagttacgtagtattcgc

SEQ ID NO: 38592 - DNA, 399 bp, Neisseria meningitidis
acactctcctaacactcctggctggtacacgttgcttgaattgggcccacaccctagatggtaccccgggaccacctggacccccgtgcatctgaaggtcggacaatgatgtcgatttcgttggacccggaagtggaccccgtgttggaccccgcgtcgttgtcgacggcacagatcctggccccggcgccgcacgcaactattgtattcctggtgatactgttgttgtgtcgcatcccggtaccattggccaagatcatggcgtcgttcgtagacgaacaagtaatgccgcccgttcgcttgtgtattgcgttcccgttgttgcttaacgctcggtcgaagtggatcggtgaattccttgtttctatggacctgttgttcccgttgttgtgcgcaata

SEQ ID NO: 38593 - DNA, 923 bp, Neisseria meningitidis
ggtggcggccgctctagaactagtggatcccccgggctgcaggaattcggcacgagcccacagtgagtttcccccacactcggctccttggagccccgacagtccatagcaccccaggagatgtctaaccttagggacttggaggcctcccaggggtctaggccagctgagttgtgaagttgcatggcagggacagggcagggccgaggccagggttgctgtgattgtatccgaagtagtcctcgtgagaaaagataatgagatgacgtgagcagcctgcagacttgtgtctgccttcaagaagccasacaggaaggcctgcctgccttggctctgacctggcggccagccagccagccacaggtgggcttcttccttttgtggtgacaacgccaagaaaactgcagaggccccagggtcaggtgtaagtgggtaggtgaccgtaaaacaccaggtgctcccaggaacccgggcaaaggccatccccacctacagccagcatgcccactggcgtgatgggtgcagagggatgaggcagccaggtgttctgctgtggtttgggagcctataaagtgagactaggctgggcatggtggctcccatctgcaaaaccagcactttgggaggccaaggtgggcggatcgcctgaggtcaggagtttgagaccagcctggccaacatggtgaacccccatctcttaaaaatataaaaattagctgggcatggtggcaggtgcctgtaatcccagctactcaggaggctgaggcacgagagtcgcttgaacccgggaggtggaggttacagtaagctgagatcttcccactgcactccagcctgagcgacagagtgagactccatctcaaaaaaaaaaaaaaaaaaactcgagggggggcccggtacccaattcgccctatagtgagtcg

SEQ ID NO: 38594 - DNA, 639 bp, Neisseria meningitidis
ttaatcaaactttaattcattattaaatgcctgcaaaaatatataaaagcgggtgggttttcccgacaaatagttttaattggagcagctatattttttttggtgcatgcgtaaaatcttatttcattatttattttgaaaaatgtattaaaacaataatggaattggatattgaaatatcaggtttttttgaattagattattatgaagataattataaagtaaattggaaaataaataatggaaatttgatacaaacgactaattaaatggacaaatataagttagattggacacccaaacctaaaaactgtctgaaactcaatttggttttcagtaagcgtaggttggcttaaaaacccaaccaccaaaatgccgtctgaagcggtattcagctttcagacggcattttgatgaatgaaacaggatattgagaactaagttctttaaaaatcctacacctgctccttccacggcagcaccttggtcaaaacggcagacggctacaaagccattgcccgtatccgaaccggcgaccgcgtcttcgccaaggacgaggcaagcggaaaaacgggatacaaacccgttaccgcccgattacggcaatccgtatcaagaaaccgtttacattgaaatttc

SEQ ID NO: 38595 - DNA, 783 bp, Neisseria meningitidis
  misc_feature (1)..(783): N is any nucleotide
cccgcccatcatcgtactgcccgaaagggacgtacccggaaccagtgcaaacacttgggcaacgccgatcatcaaggcatcaatcggacgcaatgcatcaacatcggcaattttaggctctgctcggctttggcgtttctccacccacaaaataaaaaaaccgcccaaaaccagcatgactgcaacactcaaggggttaaacagatactctttgatttgtttgccgaacaacagccccatcacggcggcaggtataaaagcaatggcaagattaaggacgaagcggttggctttccggtcttttcccaagccgtgcaacacattgctgaaacgttgccggtattcaaacactaccgccaaaactgcaccgagctggatggcaatttcaaaaaccttgtgattgctgtgaaaaccaatcagattgccgagttcaggcttcatgaagcggaggtcaaaccgatcgacagggagaaggtgccggggcaggtgcgggaaaaaggaaaagttttgcagattgacggcgaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaagcagacggtanggtgaaggangcgatttcccattaccgggaattgattgccgcccaacccgacgcgcccgccgtccgtatgcgtttggcggcagcattgttt

SEQ ID NO: 38596 - DNA, 393 bp, Neisseria meningitidis
gcttcagacgagccatttattatatggagattatagtggattcaggaagcgcgttctttcgcgcgcgaagacggcaggcagtttgtcgatgccgacaaaattatcgccgccgcctacggtttggcgttttctttggaacacgcttcggaaacgcaggaaggcgggcgcacgttctgtatcgccgatttgaacattaccgtgccgtctgaaacgcttgccgatgccaaggcaaacagccccctgttgtacggggaaactgctttgtcggatattgtgcggcagaagacgggcggcaatgtcgagtttaaagacggcgtattgacggcagccgtccgcttcctgcccgtcaaggacggtcagacggcatttgtcgacaacacggtcggtatggcg

SEQ ID NO: 38597 - DNA, 193 bp, Neisseria meningitidis
actatcttctaaaggttcacttttctccaaaatagaaaaggcagcttggatattttcaaatggcagggaaggcaaatcttcaacgagactgccacaaatagcgacaacaggaactccgacaagggttctttttgctacaccaataggcgctttccctgctaaactttgacgatctagtcttccttcaccaacg

SEQ ID NO: 38598 - DNA, 474 bp, Neisseria meningitidis
tttttttttttttttttttaaaaaatatcatttattcttttataaacaatagcaataaatttattatatgttaacagcagagtgatgacatcatcacgtatcacatagcttctggaaaattccaccatacacttttgagagaaggacagataaatggtcgataacatcttagtattatcatggaaaagttttgatcttatagacccctcaacacccaaaagtcgtaatcagttctactcaagtaagatttaaatatatatctatattttctggtctgagattcttttcaactttactcagaaaacatatacctgaagggggagggggagagtgcacagatgagtctgtttgtatgtggatggtcacagaaatgacagaaaatagttatttaatctgaatctggaccctgctgaaaactgccgtgatttctcataacactctcctgccccttcagaagtgaaactggctgatagt

SEQ ID NO: 38599 - DNA, 369 bp, Neisseria meningitidis
cgattattctgacaatcagcattttcagaagtatgcctaaaagtggaatcagaccggcaagtaatggcatttattaccccttgaacgaaccgaaaacgacaaaagccgacataatgataaaggcgagcagtacggcaaagcggattttttcggcgtgcacgcataacggctcatagcttgcctgatattgtctaccgaaaacatgaaaggttttcggctgcggacatacgccgttagacggtaaaaagttatgtgaagaccatgtcgtatcgtctataacctgcggtatgcttatatcgtgaaacatgccgtctgaaggtatgcccatctgctgacaggctatgatttccggaaaataatcgcacaaaa

SEQ ID NO: 38600 - DNA, 186 bp, Neisseria meningitidis
cgacgttgagtgcccccttaacttaaactcccccgtgatagggtgccgaaaaacgtaactggtgaatgcttgttggaaatcgttaatattgtattgtttcctctgcttagcgtgtttcgtaaagtacttggtatcgtgctagttaaagatcgtgttgtggctcgttgtacccctgcgcctgcgtta

SEQ ID NO: 38601 - DNA, 394 bp, Neisseria meningitidis
gcgcccgccaaacgcggcaagcggcataccggcgccgatgactttgcccatcgtggtcaggtcgggcgtgatgccgtgcaaagattgcgcgccgccgagcgcgacgcggaagccggtcatcacttcgtcgtaaatcaacaccgcgccgtatttttcggtcaatccgcgcaaggctttgacaaaggcttcggtcgggcggacgaagttcatattgccgaagaagggttcgacaatcattcaagccatttcatttccactgtataaagtccggtcattacctgtgctttgcacctcttggaaaccgggcaacggctcagtggcagggttggcaaccaaagtaaccgtatcgccgactttcgcctgtcccaattcttttacgccggtattcaaaaag

SEQ ID NO: 38602 - DNA, 781 bp, Neisseria meningitidis
  misc_feature (1)..(781): N is any nucleotide
gtccgatttgccgacnaaaccgggcctgaaagtggacctagagggaagaacgcgttaagaggacaacttcgagctgttaaagacacctgcctagggggtaaatgagtggtgaaaccggtatggggtgttaaaagacaaaacctactggccagaggggtaaagcctacccaacctaaagtggtaatcacatgcttataaagactcataataccaatgttcataccccggtgggggctgatattaagacctctgggtttgctgaaatgggcatcagtgacgtggttggtattaatcagaattaacgtaatagtgcatatgggtggagtaaacgtaagtaacgttacctaccgcgtaaggttacagatcagatggcttgcactaaacctctataaattattactcagcttgttattactgttgctgttgggaacggggaagcggctaccccacatgggggtagaaaaagtggcgaggcttgcagtgatccttgtaaatagacgacaagttaatttgggggctggcttaaatcgagaccgtctattggccgcgttatagaacccatgtataatagtgctgaaaagatcaagcgcaatagtggtaccaagggtagactcaggggtgcggcaaatacaactgaccgggacgaaccaggcattctaaatcccgaaactagggntagttgtagtagaaaaggcagaattgaaattactactaagttttagattgntagtaggatgccttcgattcntaatcttaagagacagngtgggaagggtggcat

SEQ ID NO: 38603 - DNA, 447 bp, Neisseria meningitidis
aagaaaacaaacctcgcccccccttctacgccccagggagcgaccataaaacgaaactgtcgacgcgaccacactggacgtcgcctaagtgattcgaaaacagaatcccccctaggtcgttcccgcagccaatggcagaaacccagataaactttgaccgtgtatccccaatatactccctccaccgtggacagaacatcaagcaacgacaaagacgtcaccgccaccccaaggatgccagaccgaccacgaacaatttatagcaagagaatttaccataccacgaatgttgtataatctgattacattgttaaagccccggtcgaaacgtcgatccctaaatagttcgttgacgttgcttctcttgttcacccgtgtgaatataaaaagtctggtagctaagactgttatgcaaactgttgcaaattgttcccgttgtgtcgtgtt

SEQ ID NO: 38604 - DNA, 543 bp, Neisseria meningitidis
ttgcaccgggtaaacacattcttgacaccacgctcgaaaatggacaccttacagagtaaagtggcccggaatatcgttaacacgttgatgatggtagtggccctgcgcgtaaagcctttgaaggatgtcaccctgtcacgggtgataattgtgataatagcgttgacctgtgtcatcggggacccgcggacgataagtcggccgctggtaaggtaacgcctaccccgacgaatcctggtgaccctggtaggcttggcatggtaacttgccaggttaggaagttaagaacgttgctcgaaaacagccctagatggtacccgtcaccttctatccccataggtgagctcaatgccgctggaccccttcattcactagcttaacacatgtaggccccgtatggtgaatcgttaacaccgtttcgacgaaactaacgcgaagatcgttgccctagtgaattgaggcaaaccgttgaaagtgctagtgttattttcgtttatcgtatgttcctaactggcccgtttaatttgaaacaactgacgaata

SEQ ID NO: 38605 - DNA, 602 bp, Neisseria meningitidis
tttgcgggtcccgctcccggtaagtagtctgctgtggggtgtgacgccgatgacacctttccgtcggtgtacactgaggccgtgtgttcgtacaattaaacttaaagttcgactttaaggtatacttccgagggagagggctaccccgttgccgatggagctgtcggtaataacgcctaccttggacctccccgttaaaactcgtaggacggcgtggaccctgatactccggaagctaagggagaccccttggttcgcgaaggccccgggtgtaccgcctatgttgttcgatctgaggccccgcccccctggtaggatccggaaggcaaagcacttgggtgtggtggacccgccgatgagcctttagccgttggtcgccgcgacaactagtcgggcgctgtcaccgaggtgccctagtgcaattccccgaattggcgccccaaagctcgttatacttaaatcgtgccggagtgcggctggtaaggcacggccccctagtgcaatgacgacgcggttgcgtcgccggtcgacgcagggtcgtttggtaaagtttaacgtagttaacctgacaacgttggtacccccgttgctcccgtggaaac

SEQ ID NO: 38606 - DNA, 601 bp, Neisseria meningitidis
gttccccctaacacaatcccgacaagaaggcacggtaacgatgtcgacaacgttgagcactgtgatgatcactactactctaactaacgcaaatttcccccgccttaccccaccatctactaccaccgtccatacaagaccgaaggatgattatggcaccggtacctccattttaagttccggtagcaatttgacaaatacccctcttgcctcctatgtttaaacacctgacaacacaatgcggtaccccgtcgatgtcctctgcgttccctccacaccttactttccctccgctaacgtataggctggcagaacccgtagggtaagaatgtcctattgttctaatggcgggtccgttccgtattatgacaccgctaaaagttctcctaccactaccacccgcttgtatacctatcgtggtatatagattccccttatagcccctgtcaaacgcaattccatcgcttgcactacaccttaaacttaaaattcgaagcctgttcctttgtaaagttgttctggttaaagataaagttaacccttcgctcgacctgccggtatcgacttgtcgtctggcaccgcaagatcgtgtggtagccat

SEQ ID NO: 38607 - DNA, 622 bp, Neisseria meningitidis
gggcctaaggtgcgacccctctggatgacccgatcacggagggtgtgcgtggggtaggtggtactaaagaatgtgtttgtacccttcccgaggtaggccgtgatactgcttctgctcgtaattgctttgattccgcggacgaatcgtgtgaagacccttgtaccttcgataactttatcccggtgtaatgccggtaacacacggttaatatgtctggtagcgttgttgtgtaagttgcgacgtagatggtggacccttaagtggtgtaagttcccgccgttggttccgttctgttgtaggatatggtgggtggtgcgaaagctggtgaagttccccaaattggtcgtgccctaataactcgttgaccctactaattgcccgctagggaaaggtaacgacccccctggctaggcagaaagccactccaccgaaccatccaaagacaacgacgaccactaatatcgcacctaaatataatgccccaaacttgtttgatatgtggtaaaaaggtaaaatggcacaggtatgttgtatcccccgtgtcacaactatgttccatccaacctggaacgcagtgtaatttggcagtgtatcctgcctgggatgaaaggggtggaggcct

SEQ ID NO: 38608 - DNA, 452 bp, Neisseria meningitidis
ttccgcctccttatgtcccttatccttaaacttgacattgttgcgttaagtatgggactttagcctattaactgcccgttgcggcaaactaagttccgtctacataggtgtctgaatatcctggccatggccctggtgtgtatgctgcttactgcgaaacatctgtctgcttagctggtagagtagtttatgtggtgtacccgccgggcaactgcgttgctggaaatcctcccttacctttatatccctcttaaaaaccccctgtgatttaagctacggtgggatatgccccgtgtagtaagtcgatgtctaattataactcgtgcggtcacgtttgtgcggctcgcgttgggaacttaggtggcgccgtagttccctacgtggcagcagtgggctagattgcttacaacggcccggccgaaggtacgatttacgcgtagtgcgttggccat

SEQ ID NO: 38609 - DNA, 621 bp, Neisseria meningitidis
tagccgataaatggtcgccgcccgcctgttacaagttgtaacactaagccacagtggaccaaacccaaactaggataaggtaatgaagttgtagatagcataaacagcatggtaaggtgagacaatgttgcatcggcccaaacccaacttatcacatagacaaataacgttgctcgaatgtaacgcgcctagatggtacccatccacttataggcccgcctaagttccagaccccgttcgtgaagcaccttaaagcgtggatgagccggtaggcgcaggataccctgccgctgcattaggtaatggcccctattaaccgcccgttgtttatggctactatgtgggcccgggctgtactgaagagtgagttgcacctgacgttgataatgctggaagaaatgacccgactcctgccgcagttgcaagacctgtcggtggtggtccctactgtggtgccgaccctcctcccggccatagggtgcctgaggacggaaattaacctggctagtgagttgtcggtaatagggatgtgccgggtggagttgctgagcccgttgcctaacctggggacaattagattgacggttccggtggtattggcgtcgccgggtatgacgccga

SEQ ID NO: 38610 - DNA, 449 bp, Neisseria meningitidis
aaaatttcggtgccatttaatccaactgttccgtagtatactttttccctgttaagtcggtggcaacagtgaaagaggtttgtattgactgtttcctttaatagccgtgtagttcgaacggtgaacggtgttcgacgtggcacccctcttccatgtactcgcgtggcaccctatattgtacacggcgtatctctagcataactcgtctcgacgttgtacagccaagttagttttcaatttgttaatatttgccgatgtgtttcgatgggtccgctcgtctttggtacttgtccatagataagtcgcgattgctcttgggagtcgtacgcgctagaggcccctattgctactattgaaatgtgtgagcatgaaagggttctgcgacatgttcacccccacaggccaacgctacgacaacaacggccctccagatgctaggcggtatcccc

SEQ ID NO: 38611 - DNA, 700 bp, Neisseria meningitidis
  misc_feature (16)..(16): N is any nucleotide
ttcgtcaaaccaaagnacaactacagacacggcagggcaaccagagaaatattccacaccgacgcagccgtactcgacgccaaaaacaaacttacaagaccaagtccggcccgcggcacctacctacacgtcttacgcgttaaccccacaaaacccgtaaaaaaattcgccaaaacccacccccacaactaattctaaggagaccccacagacaacgcaacacccgaaaccaacgacggaaataaaagcccgcatccgccagacaagcacaaaatacccccctccaccgaaaatagcgcccgcactgcaccaaccaccccacacccaaaacccaacccgtccccacacaggatccatcctaacgagccggaacagccccggcaaccccacgagtgtatgtctacttgtgccagtagaacccggaaacacggccgtcaacccagccctcgtaaaaaacgagaaagacactctgaaatgcaacgaacaccataaataagtcggccacagcgtaccaccagtacccggcaacccggtcagcaacaccgtattaggcagcatgctactgtacaccgcaaatggaataaacgttctcgcgaccgtaagttgctctctcggaaacacactcctagtcacctaggagtacaaagacggcaaagccaacactaattgcccctaaaacaccccaatggacccacaccta

SEQ ID NO: 38612 - DNA, 567 bp, Neisseria meningitidis
aaatataatccgtttaaactgaagaggcccggtcggtccgttaagaagaaccggaatagaccgaaatcgaaactgagaaatagcccgttgagtgacaaagaagtgtgggtagggcgtccactcccgttcgttaacaatggcacaacctgggtgccactattggtccccattggcacaaatactagatcccccgttgatccgggctcttcgctttcccttggtgtggtggtgtaagttcatgcacattaccgtaatctaaacggtaaaagtgcacacatactagttttagtaggaccgcgtcttgacgtggacccattcaaaactagtagttactagggaggtggacattgttcgaaaaccaaaaaatctagccaagaagttaaaacatatacagaaagcaaaaagaaaaataaaaaattcgttgggcaaaaagaataagtaggtcgttaaagttttgaaagaaaactaaaagtaattaattgaaaagaaaagtttgcaaaatgttaagaaagtaccataaaaaacattaaaaaactaaacgaccacttgaaaactaagtataccacg

SEQ ID NO: 38613 - DNA, 646 bp, Neisseria meningitidis
ccacggccctcaaccttagcgacaccactaatcccacctagacgggcaccctaaaactaatccgtcgcactcgctacaccaattcctaccgccccccacatacacgggcatcccctcccacccaacctactcgaaagagctggcagcccccggcacccggcaactttaattacaacgcccaccggatcgctcgaacggcccactcacaaactcagtgcgtacagcccaggcgaaaacgcaatcttatgccttaaccgaagaaaaagaccgctcgaaaatcaaacccaaccctagacgattccagacctggaccctaagcgtaatatcagcgcaccagcggccggaatagacctaagaacaaaatatccggtgccctgcagttaagcgccccctccggctggcggcctaatctactccgaatttcgtgcactctttgactatcgacgccatggaaactggcccgcccggggaagcaccgttggacgagcttgccggcgcctctacctagtttccctctttaagaacggccagggtgataaaaacaagctcttgtccctaacgtcccggccaccccggcgcgccggcagaatctcccgttgccacttacggcaacggcgcgtatttcgctcccacgcgttccccaacg

SEQ ID NO: 38614 - DNA, 602 bp, Neisseria meningitidis
  misc_feature (7)..(7): N is any nucleotide
gcgtggnccccacggtaccccaccgaaggtgcgcctgacccgagcgaaaaacgcgcccagccccaccctagttcccgttcgaccctactagaaatggcaacccatttgggtagcacagttgtgtggaccatttggtacagagcttgaatgttaacacccccgaccgagtagaccggtcgtggtaaaggcaatgccaatacccccacggccttagttaagtacggtactaatctgggtaaagttcggaagtgcagctatcctcccaccctccgagccgcaattgcagtgcccgttcgcattggccatgttgaccctgttgcagaggcccctggctggggcacaatggaaaaataggccgttggcaatgccgtcggcaccacctaaacggacgtttatctggctgggacccctcccgctcctaatgatccctgttcgtactatgtttaatgaattgtgtagacagagccccccggggacgacccgtttgacggtggataaccttatgttgtgtgactggcgcccgttgtcaattgtacaaacacaagggccgccccccggactggggtggcagtggacaccgaagtgcctgacccggcaggtag

SEQ ID NO: 38615 - DNA, 684 bp, Neisseria meningitidis
ttgcctttgttgcgtgtgcctgtttgcttgttttgtatctgttgccctttcgacctcgtcgggcaccgttaaaaaacggcggtcggtggggacgtcggtggaaaatcgggcgctgtttgcacccgaaaactttgtttaacctgatggtcggggtgcaccgggtggtgcgcatggtcacattccttaatctcccccagatccccttggacaccttgacccggccactggtacggtgacgtcgtcgggtcccaggtcgtttaaaaaccctcttgtattgtcctgcgtcccaaatacttgtgtaccccgggataaacggtatactagttcccttattcggacatgtgatcatactcatacttttccgggtggtagtaaaaaaggtcccccatggatatagtctaattcgacggtggtaacggcgtctctaggtactcggtatggtcatggtcggaatccttctacccggggtgtgtcgtatggtatggtatcggcgtcgtctaatatgggtgattgtcaccctggatgtgatgtgtcacgttgctcgaaacatcctgtgttgtctctacggtctaccattccttaccctgctcgttccagtcccgctgctcctaacattgtaaactttgatgacgctagtgtagcccctagcgtttctcccgttaacgttaatggtcggaacgtgtt

SEQ ID NO: 38616 - DNA, 562 bp, Neisseria meningitidis
  misc_feature (517)..(517): N is any nucleotide
gtgcagttcctgacacgcatggtactacgcctaataattacttggatccgtgttgtacttcgattgaccatggtcctgctggatacttgccttgtaaagatcctttgacccttggtcacgcggaaacgtgccatgatgaagagtaaaaatgtgcgacccattaattcgccattaccgagttgtgtgagactatgttgtgcactgcttgcgaggagaatcatggcggttaacaaaccaagaaatcatattactaatcctggtttgtaatatttcgtggtgtatggtgcaccgtgcacgaccccggagtcggatggtgaataaactgcttgcgttgatttgtacactggttctccgtattgaggcatttgaaaaatcggtggaaattaaaattcactcgtaagtttcgtttcacacggattgtccggatcacgcccttacgacggctaacgagtaggtgcaccgcccggtagcagaaaaatccgctggcactgacgcgtttacttgtgtttaacatacntgtgcgacgcccgttgaagcaatgtgtacttctaactatccgacg

SEQ ID NO: 38617 - DNA, 558 bp, Neisseria meningitidis
tccactcggataatacttgtactacttctatgtgtattagttactttgttaatactggtctcgttgtgtgtgtgacgaaaataacgggctcgtataaatcgattactgctgttttaaactcgacggtaatgttgacgatggaaaatttgtttgcgcccgatttggagtacttctaactgcccaaaccattggaagaaagtcctacttctgtccttggtgtggtagatgccctggaaaacgttattaccgttgtcctcccggatgaagtttccgttgatattattactgttcgtgtttcgattagttgatgatgtgaaaccatcgtgttggcgtaaattttgtgtgacccggcacttgaaccatcgtagattgtaaattgaggtgagaaagcggtatcggcccctggtaatgagatccctggtccgagtactgaagaagcttaagttcgtaattgatcgacgattactaatggtaactttgatcaccctctgtctaattctgtttaagttgcgtaagctgcgcgtcatgaaactcctagttaaattggcctgtttacga

SEQ ID NO: 38618 - DNA, 448 bp, Neisseria meningitidis
ctggcctttgcctgttgcggtgggggtgcccgatgatgatgtgcccccccgtcgcccggtgcgtggcacgtaggagcgttgtcctactccgtgtcctgttgatgagttggcggaagcaggctaccctccccccaatggtggtatccccgtggtgcctgggacatacggggctgagacagatgacgctgggcccgttccgcgcccggataagcgtgggtacccgcctggtggtgccgttgaaacggaggccgacgcgtgtggtggcgccccgtgccctgggaccgaggagggtgtggtggacgttgctcgaaagtaggtaggtgatggtgggacgccgtctgaaggtggcaatggttagtttgagtgaggtgaggatgaagtcgctgtgttttaacttcgtggccgtgccttaaatggcggggcgtgtggcgcggccgatggtcccggt

SEQ ID NO: 38619 - DNA, 627 bp, Neisseria meningitidis
ctggctttcgtagcgttaaacttaaagttcgcgtgtcgagattgttggccgtggtagaattggtactgtgggcccgtagggaacgggcaactgctgaaaacaattggtaggccgttgtaagctcgccctactatgttgaaattgagtacactgataatgaggccgctgcagttgaagtcgtcgttgtgcctgtacaaaactagccctttgccgttggtcctgcggaacccccttataacgccccctacccgagaggggtcgaggaatcgaggccccccgacgccgatgatgccgttagcccccgttacggtaattatcaaactggctcgttgtgtaagaaaggtgggaagtcggacgatactgtatatcctggtgatgggccggtatcgacggggcctgcgcatgctggcaacgatggggacgttgaatctcgtcccgatccccctaaaaactcccaagttcctccttaagttcatgttgtgacaagaacggacggaggaatggcccgttccgctgaaagaggtcccaaagacacagggaacattgagcccctgggcaatcctgatgcaacgtgtgtaggcccggagggcggaacttaagtcccttaaaatgccgacgttgttgaac

SEQ ID NO: 38620 - DNA, 526 bp, Neisseria meningitidis
tatttagatacaatggctgtgccctactccaactagtattatggtgtatacaactaaggtcatgttcgttagtacccggccggctgacgtctgaataaaggttagagtgagccgacgttgtttaatgggctggctatgtttgcgcagaggaagcagttttataacgttatggtgaagaaggctgtaactaggccggtggggacggagctggcgccgttgaaaggcccgcagaagacgtcgtttaagctccgaactacaaaatgcgtgatgtgtgcattggtactgatggtggctaggacgaataaggtcctaaataatagggtgaagcgacattagaatgttactactgttctgtttggaactaggtggtctacaacgcgtgttacattgatcgtgagggcgggtgtattgctggtatgggaaaggacggcgcccctgttgatcctcccagtagcgcgtaatagggccgtggtactgatagggaaccgtagtccggcggcaactatcctggtggtggcaccggtac

SEQ ID NO: 38621 - DNA, 635 bp, Neisseria meningitidis
actgaacttagtttgtaggtgatgtggcaagtacggtgtatagctcttcgtacacttagtgtgcatagacatggatggaccctcctaactggtaaatcgcggcaactggtaagttactggacgaccctccttgaactattgatgtagcaaagtctggcgtggccgtaggcagaaaggaccattgttcttgccgttgtaccgtcctgggtaagaccgtggatggtcccaggtagggtggtggtggtaaatgttagtcccctttgcacgtccaaaggcgtggcccgacgaccgagcttgatagtggcaagccgtacgaaaaaactggcaaagacgaacacagattgccaccacagttcaatcgtccttccaaaatatggataaaaaatcgtattcttgattgtaaaaacgttgctcgaaggcgtagcccttgcccgcttggtggccgttgctgggtagttgggtggcccaacttatcctgtttgtgcaccgcctggtagctagtagatcgctgcaactggtaatgcccgttggcccgagcccgaagaattagttcgtattgcaaggactgtcgccggtagcccttggagtgtccggtaaactcctgccgatggtaatgatcctgttcgtaactggcg

SEQ ID NO: 38622 - DNA, 692 bp, Neisseria meningitidis
tctggcctttggtgccgggtactactaacctgctgaaactgcgtaacctgcgggtggtggctgttacccggatgccgcccctgatgagcatcctggtggcgtggctgacgagcctgggggtaactagtggtctgctatttcgcatgcctataataactaaacgtggtggtagtcctagtgtgatagaggtcctggtaaggtgtgctgcgttgtccctgcgttggcccgaagctacgatgatcctgacattgcgtgttcgataggttgctcgaacactgggacggctggcggtaatgatgatgtgtgtggtcccatcccccgttgttcgcctggtaatgtgtatgattactggcccgttgcggacgcttgttaaggtccccttgggtaggtgtgatgaacttagttgtgttggaactaacatgatgaacctggctacgtcccgagccttctcctgtctaatgtctgtgtcctgccccttagtacacagggaacgttgctcccaactggacaggtaagtcctgttcgatggtcttataaccttcgcccgcttcgacgacaccttagttcgttcccggcaatggggtagatgaggacgctcaagaaccccccccttacagggccgtccctgggcccgacggcctaactaactggacgtttctcctaacaccctagatggtcactacccaccctcg

SEQ ID NO: 38623 - DNA, 634 bp, Neisseria meningitidis
  misc_feature (584)..(584): N is any nucleotide
ctagtctgcttccgcctacacatcgtatactgcatttgatgtgtttcgctgaaaaaacaagtgcagggcccgcaagccgctcgacgttggacacgtggtagtccgttgctgccaactaatcggctggacatacttcgtttgatagatccaactttgcatacaaaactgtgtactgctctcccttgaacgatgaatctgaccgtgggtctgctttgacgaaataccccactgatttggatgtctaagttgcacctccttgaaagtctttgccgtaatctgcgtacagtgggtgacgtagctcgcccgaggaaccccaaaacacttcgtcttcgtgctcggtctaccactcgtattagttgcctcccttatccgttgtttgcttaaaacatatcggcagggccaatttgggctctaaaacaccctccacttgtatctaagttcccttataggtcgaaatataccactagtactagtagggtaaatggtagggaaataactagggctacagatcgtaggccgttgagcttgcttgagtgtactagtaaaatggtaatggtagatactagtatgttttatacaattgntcgttattgcggtgtgtctaagttcccgctttgagaggcaacaccgccta

SEQ ID NO: 38624 - DNA, 579 bp, Neisseria meningitidis
gctaacgtccgacccctggccctatctacaccccccttcccgctggcaagggacaaggacgtggcgtgggtcaaaacttgtatccgtttgtacacacagcggaccaataaaaattagcatggtgccgttctgttccagtctaaagagaatgacctctcaaggcgtcgaagtattaagcgagctggccttgcatcacccgcatcgctcgtggtcctgttgctccgcttcgacccccgccaacttatcacaaaaacaacaaagaactacaaatgaaacccaccactatacacccccggaaaaaacactacccgtgcgacgcccccaagtaggcaccccatcacctcccatagaactgggaccccactaaacgggcctggtagctggtggataattgtctaaaaaacacccccgttggatattaagggcccgcctacatcgttgaattcgttggccccgtacttcgaccgggcgcactgttccccgcttcccacaacgttgttatccacacccgttatccctttgacgaagttgcccgttgaaaacactttttatagttcctgtggtaatcgtcgtgatgaa

SEQ ID NO: 38625 - DNA, 638 bp, Neisseria meningitidis
cccattcgaacgaactgcattaaaaccggcatccaacttcgaccctttactgtcgttcacaggacatcttaaaactaataataggacccttctccgtcttcccagaaacaatcggacaagtattcgaacgcaccttgcctaataacctccgaggaccaacgccccgacccaaagcatctccattcctaacgcagccctcacgcttcgaaacacgccctttccgagtcttactacgaaccccagctttaacagaccccgtcccaaaactaataccgtgggcccgaaataccctcttactcatagatcgagacaactccgaagtagcgccacgtccgcaggagctcgagaaacttttatcaattgtagttccttttggccccgttgttcccgctaggcccccgatcccggtaaatggtaggatgccgattagggtcctgatggccctggtggtaccggggccccttcgtacttatcggctaatggtcctgtttgtgtcgacaaaggggccgagtgtgttggtggtgatgttgccgacaaatcttacgtcgccgttttaatggctgagtccggtaccgcgtctgaataccccctcgccggtcctactggtgtggctggagaaaccgtcgttgaggccgtcg

SEQ ID NO: 38626 - DNA, 122 bp, Neisseria meningitidis
aactaggatggacggcctacatggtacggtccaccttgccctttaaaccctgcgtggaacgaaatctctggttctgcaccgttaaagtaccgcgcttaaccttcgaagtcgtttgaatgaac

SEQ ID NO: 38627 - DNA, 566 bp, Neisseria meningitidis
ccgtgtttagcagcgggcgaggcagaaaggtcgttgtggccgctgagcctgttggtcccatgcccaggtgacccgctgcctaatagtagccccctggcggtcgtacttaaagcgctggtgaggatccgggtcccggtaccgttggccccccgtgttaaacgcctaaatgacctggtgagcgtgaggaacctgtttagtgagctttagtgtaaacggcccctcctgaggaaccgccgaatacgccctggcgtagaattgcttgtgttggccctaaatacattgttgttgcctactaacggaatgacagatagtacccctgtgtccgcgttgagccttaaaaccgggaataagctggctaggcagctgtgtaagataccattggccatggagacggcgctcctgttgccccctagatgatttaagtcgaatccggtggtcctcctaggagtgaggatgtggacgctgaggttaccggcacttagcctggtaaggcaggtcccaattccggtgagtaggtctccgctgcgtggatggcccctgctgagttagaatatggtaggtgcgcc

SEQ ID NO: 38628 - DNA, 627 bp, Neisseria meningitidis
taccccgccaacttatcacaccctaaacctttctctccctactaccacccaaacgtcactaccaacacaaccaataaaaccctacccttacatattgacgcagaagaacaataaaccaactcacccacaaatcttgacctccttctactgggccacatctactagaaacatctatcgaaacacacgttccccatacggaaaactatcagatagccgaaaagtaactagctagccttcgccaaaaatgtgcgcagaacccttgtcccactctaactggatatggccctaacacgctccttttcctaaacattaactgctaaattcggcttagttgaccaattcacacttcgattgccgttggtgtgatcgctggccctggtgtgatgcggtgccctttgcacccggctggcgaaaatggcggcgtgtgcacgcgcccccacctcgcactgtgacgtcggccactggtactttgacgaccccggcggaaaacgctactggatggtgtaaaggtgcgaatgtgtcggacgtgcctggtggtttgacgaatggtaaatttaccgttaaaacccggaaatcggctggtcggacgggtcgtctggtgtgcctggtactacggtccaccatacg

SEQ ID NO: 38629 - DNA, 595 bp, Neisseria meningitidis
ccccggaaaattgaccctttcgtaaagtcgtcgctcgttgctgaaatgtgccgaagcatggcgtggtgtaattgaatggggttcgcacctgataagtcgggtaatagcgtggtgacctaggaaacgaattgcgaggcaggggtcgtggcgaaacgcgttctctttgcatccccgatgggtgaggtgggcctgttgcccgaaatggcggtatgtcacccttacaaaaatggcatgttgcgggctagtttggtaagggctgaacactcgactgacacgttgacggaatcgccgtagaaggtggagggtggtgccccgcacgctggtgatactgtttagcatagttgtaatacttaagttggcaccgttcccaccgctggaaaggtggaatattgttgtgctagggcggctgtactgggtagtagggtggtaggcctagatggtaccgttcgtgaggaaaagtcggtggaatcgtcgctggaactggctgcttgcaccttgttgtcgtgcacgtagtacgaagatacctttccttcgacataggggaccgttcgtaacgcggtggaaagttaaaagaccgtgttcgttctacctagcg

SEQ ID NO: 38630 - DNA, 686 bp, Neisseria meningitidis
ctggcattttgctgcggtccccgtgggccccactggcaacgcccctagatggttcgcttagacaccttgctaaaaattgtgtttacctgttgctcgaaaatgttatactgcctagttgtcgtaatcgtgtgtgtaggccccttagtagttcgtcccggtcgcctaaacttccgtggcacctgcaatttcgacctcgtaaactggtgaccaatcttgtccttaattggccccttgaccggcagtcgtttgatcgcctgacccccctacaccggctgagtatgacgaaacctggtgccctagtgacgggcccggccctgaggcctacggtccactctcccgcctactactccgaaaaaaaccacagccacttagtaagcgccgtaaaagtaacccgatagccctccgcctccgcggcgccggtctggtaaacgttctaccagacaacgcagaacgatccgcaaagccaacaacatgccgaaaacagccctgctcgtcgctcctgggtaaaacactagattcccgtccacagttcaaaaaaccagtcgcccccctacataggccctctagtaatacaaaacgaaattgcctcattcgtcgacctctgacagtccccctaacaatcttccccaagcgaaggcgacacgaaaaatccccaccggaactattccgccccctaagaacactaa

SEQ ID NO: 38631 - DNA, 599 bp, Neisseria meningitidis
gggtccccgcctcccacgataatcgttactcgctgggtcttgagctgcttccgatgcttgaagagccgtaccatggcgccgcgtagaagccccagaatgggagattccagcttcgtgcaactcggggtacatcctagacaagtaagggaaaattcatagtagtctgctagacatctgcagaatcctaagtacctgcgtccgatccgtcaatatcttcttcgcgttccctactactggctgctgcgtgggcagcttgcttctctctggcacttactgggttaaaaccgtcttctagatctgcataatccgtactattaaattcaggaatatccgagtcaattacttgcgagtcaagcttacttacttcctatggtcgatcctccgtagcgatatgcttatctaaattctcttcgtcaggctattggtttactggggcttcccctgcaggcttcctctcaggggcgcgggcttcaatcttggcttctgcaaagatctctaaagagtcctaatttatattaaatttagtatcctcactactcctaccctagtagtcccagctccctctaaccagatcactctcaattaaaatctagcattac

SEQ ID NO: 38632 - DNA, 589 bp, Neisseria meningitidis
  misc_feature (549)..(549): N is any nucleotide
tccttaatgcgttcttcgagttactagaagtgtcccaaattcctaagaatcctaaaccgactcgagttgcaggcaaatttctttatatgggcttctacttcacagataggcttcttcagcttcttaagatccctctcttctgtagtttgcttcagttcttcatgatcctcactcgcttcaaacgtttgggcgctcaagtggttctatccctgggcaaaatagccccaaaatctaagcttcgtgcaactagtgcctcctcctgtgtcttgcaaacagcaaaaatcccaaataggcttttgttaagtccggaaaagaacctgtcaaaataaattcaggtgattcttccaaattcaggagcaaaaataaaattaaacgtgcccattgttttatttcttggggttatgcctgctggcttctcgattgctttgggagcgccgagactctcaaacttcctcctcagagctgctaagcctatatctctcgtccctgcggtcgttggggttgctgtcgagggtcttgtgctgcccctagggcccctactcagattcnttcgggggcttcgggtcgttaacctgccctacctagatct

SEQ ID NO: 38633 - DNA, 666 bp, Neisseria meningitidis
  misc_feature (584)..(584): N is any nucleotide
tcggcttaaatatcttcttggtcgcggtcctcctcggtttaggggtgatattttggccctccatggtttctggcatcctaattctaaaactccttgctggcggtttgtatgcgttcttccggtccatcctcgggtttgggttcggtttgaggagggtaattggctttttaagtgtcagcttatcggtctctttactcgcagtcctcaatctcctctccgtgggcatccctaccgatctgattgctccttccaggagcttccttacgttcattgcattgcctgcttctatcataacaaaactcctaccaagaattctgagtacctcaaagcctactagtcctatcatagggttcatatctggtacctcccgcgtcagggtaattaacgtgttcatactcctgatgattctcatggggatcctaataaacaaagtcttcctaatcgtaattgtaattcttcgcgagcctgccaggagcctcctaccctcctccctcctacttgcaagcttccttgggtccggtgcaaagattacatctgcctaaattaaactcctgataaacataaattcgagctttgtagcttcncttgggtccgtcacgcctcgaaaaatattcctaccctctaaagtcctcgcgttctataagggatttcaggtacttatcatac

SEQ ID NO: 38634 - DNA, 583 bp, Neisseria meningitidis
tggaactcgtccatagggttcctcctcctgcgcttcgtgcaaatctttcctcccccagctcctgctcggggttagtcagaactagaggggttccatctcggtcccctcccggggtttccctccttcttcagggcgggctctggagagacgccaggaataaaaagtaccataacctcatcaacttctacatacgataaagacgatccaattcaggtatggccgctggtactattggacacaagtcggtgtgggcactgaacctcacctaatcttcgatgccgggggcggaagttatgagaaaaaatatgctactaaagtcgggaaaaataactcgttgggggtccgtccctccaagatcctacccgtccgggttactaccttgggggcttggcttcgggtcagggctcttagcaggggcctatgtccgatctttcgctctgttgctaatagtctcctcccgatcttcgtccgtacctctaccctcggtagtagcaaggtcaatcctaaagtggtcctactcatccggggctcggtcatcctggtatgtccggcctgggctaggaacctcaccgacgtcggcccc

SEQ ID NO: 38635 - DNA, 582 bp, Neisseria meningitidis
gccctcaaacctatccgaaaacaagtcttgagggccctactggtcttagggattagagtaactgtcctaatccctctcgtcgtaaaacttaacgttttcttttggatgccgagcgctctaataggatattcttcatggcccatcaaattcgtgagagtactgccttccaaaattaattcatgttcggcggttcggcagggaaccccaagctaagcaattggaagaaatgcaaaaataaatgcggttcttcgatcccctactcgctccgcaggcttcgattcgagagggcctggggccgctgctggtgcaggttcggtcttagtcgctgcaaaagtactgggcttcaataacaaagtcttagtttcttcgggatgttgggaatcatcagtcagcaccagggcccgtcgtgcaagaggctgcgtactgattaaaaggagctacatagtggttaaaagggggccacgatctgtaagctcggtcctcatccgcaaaatactaagagtgagtgcagcatggaggccgtggtaaggaacatgctctgcatgatcatccgaagggcgtgctgccgtccggagttcattc

SEQ ID NO: 38636 - DNA, 628 bp, Neisseria meningitidis
taaacttggcaaatactttctctctttcagccggcttagtcggcttcctactaaacgcgttattaactgcattagttgtcaagtctgcctccataaacgtcattaatgtagtcgtcctcctccgagtctaaatattggttgcggcctccaacctaaacttagtcctaaagtgggcctccaatatcagggccgccaacaagttaaaaaaggagcctcaaaagcctcctaaaaccgtgcgcttctgcttcattcagcgtcgtcggcttaaacttgggcttcttcagctccaactgcgccgcaaacataggcttcttcagctccaactgcgccgcaaacataggcttcatcggcttcaacatcacagcaggggccatagtccgttcaaagttctgcttctctggcttcagggctggaaacttcttccgatccgtcgggccaatcccttccgtcctcgcggtcacgggcattaaggtctacctccgatcaaactttggcttcaacttaggctttaaactaaactcggtgtcaggctccctcctcctcatatctgcctcctcaggcttaaaggtcctcggattcaataaagtcctgatagtggtattcctcctcctctcggttggcacggtgg

SEQ ID NO: 38637 - DNA, 605 bp, Neisseria meningitidis
tccggtcgttataaagaaaactccgggtagcctcacgatctccctcagggtcatctcttcttcggtcttcttccatactcatcctctcccctgctcctcgaacgcgttcagaggcaccgtcctcactacgggggtcagggtttgcgtcagggcagggggagtgggccggtgcagggttaacagcctctccagcggggcggtcatccgtaggggctccaagagtcacctggttgctcctaccgacttcatattcacctccctctcggtcgcgagccctaccgcctctaaggtggcgttcgtgacccggatctgcttgctcgtcctcctcagcacgttcataagtagcgacaactgccgccggggatttctattcggccctttcactacgttcagcatggtcttctgggtcagggtcacccacaactggggaatcatggcctcggggggcaaatggggggctaccggggcaataataacctcctgcatcgggctatgtagaaagagtgtggtaagagtggtccgtcctagagcttcgttcaattcccgggagagggtacatcctaggggcccaggaggtccagggggctcgatgtcaacctgccaga

SEQ ID NO: 38638 - DNA, 625 bp, Neisseria meningitidis
  misc_feature (1)..(625): N is any nucleotide
aggcctctcnaanaanaaagttgtctgggtccttctactagtaattacttgcttttctgtcatagttctcgtaatatgggcaaacctaaatctcagaaacgctgcttctgcggctaacttcaaacgcttcagctacacctaatcttggaggtcttggcccctagttcttgcaaaaataaaagtctctggaataaatatcaatgcgggggacatcctatatgccaacgttaacatcaacctacttactgctggcttggaggccgccctctaaaatcacctcaaagtaggcgtcagggtgcgcttccgcttcctccgaaaattggcctgcgtccgctctaaagcctcaataaacctacaagtgatcttggtcagagtcttcaaaaatcttggcttaattgtaaattctcgagcatttctcttccatgcattaagagttattttcaatctagtcctactcaatatcagctttcgagtctttcatgcctacctaaacttcattcgcgcggccgccatctctttgctgttccgggccctatgggatcttctaagtttcattgtaaagattcttaagttcntcaaattcgtcttaattggggccaatactaatatactagttgtcagcttc

SEQ ID NO: 38639 - DNA, 492 bp, Neisseria meningitidis
  misc_feature (416)..(416): N is any nucleotide
attattctccttcgatgcttgagttttgctgcgttagcggtaaacttcgttgctgtccataagcctatacttgtgttcagtttcaatgtcaatatacttgtaggatttctagtcagggtaattgcggggcttcggggcatcaatgcactagttttcaggatactattggagcttctgattctaattcctgcctctaacataagatttgcgtgcaatgcggccaatgcaggaattcttaatgcattcaaaaaccgggaaaaagacacaaactaggtctgcttcgtcggcatcttattaggaggtacattcgtcctactaaatactcgtaccttagacaacggcatcaacaaccataaagtactccgtaaattatattcacgaaccatactcagctttcggccagaaacaaaaatccntgtgataaatgtccggataaataatagatttcgattcagctacaaactgagagtcacaaatgctataggatttttc

SEQ ID NO: 38640 - DNA, 579 bp, Neisseria meningitidis
ctcctcctaacttctaaaagttttcatacttcttgtaaccttcctcattgtcgaggtggtaatattcctcctctatattctgatgtatatcgtccatgtgatagtcctaatcctcaaggtagttagctttttactactcctaaaattagtaaaattcaaaaatgtgttatattcggggatcttaaaaatgattgtcctctatagatgggggggatacaagcacttctttcttctcttctcttccaagtctcctaaaagcttcttggaggttctgcgggtccgtactcagcacaatatcgtcaaagaacgtcccaaccggggcgcccgctagggtccagtcggcagcatcatcccgatctttaatactcaaattactcacaaatatagtcttagctccgccgtcgtcgatcgcgtcagcatcctcgtcccgcgtactcgggtccctccccgcagcgcaaggctggtcctggtggtcatcatggggcttttcacgggctctaatgtcgggcttaggctcctcagctccgtccgggtgggcatctcttatcaattcagcggctctactcgcttacgggcttt

SEQ ID NO: 38641 - DNA, 582 bp, Neisseria meningitidis
aaattctgttcttcgtaggtttctctacctcccaagtgacataggtaagctgaacctaagggagtcccaagcatgcaaatgtaaaaaatgacaggtttatgggtcgcccaagcatccaagcgaccggtcgcccaagcatcccagctaccgggttcgagccagccaggtcgtaggtttcactacatcccagtgacataggtaagctgaacctaagggagtcccaagcatgcaaatgtaaaaaatgacaggtttatgggtcgcccaagcatcccagagaccgggttagctccatctcggtccaggtatcatgctctccaaagcatcccaggggccgcgaggtttgaaaaaaagaaaaaaatagggctaatgggcggaaaaagaaacctgcgcggggaatcagcgcggcagagggaaggtgacaaaccgactgagggaagacggattggggtggagggaaaaagactgggtgtaaaggttagcaatcttgtaagatcagagctacagctgtgagtcaaaggaacgggtaataggggcgggaggaaataggggaggggacttagggggtaagagatttttaaagag

SEQ ID NO: 38642 - DNA, 505 bp, Neisseria meningitidis
gcctaaaaaccagctcgggctacagttgggcgtcccgtcccaacccgcggggctactccaggggcttgagaagcacacccaatctaaatttcgagtcctccagcttcttcagatcccggggataggagtcagcttcgtgcaaaccccggggagttcggtacctagatccctctcaactccaccagccgcgtctctaccatcagcacgggcttcgcaaacaaagctcgccaattcctcagccgaagcatccctaaagtggctccggttctttagggtacgctgggtttcagggtcatcatggtcgtggttctcttcgcgagtagtactcggggcctaatcggcccaatcctccatccggttccatccgtccgagacgcctacatgcttctcttcagcactactaagaaagtcccgcgctctctggcgctcctaaagcgcctcatagaattcttcaaccacaacttccagaacctaaaggtccccctggtccccgcggccctctccc

SEQ ID NO: 38643 - DNA, 666 bp, Neisseria meningitidis
  misc_feature (645)..(645): N is any nucleotide
cttggggttcatagcttggttcttataactctcggcgacttcttggtcatacaacttcgttaattgggccggggcgactcggttctatccggggtagtaggcagctccgcgggcaaatcggccgaggctaattacttcgtgtaaagatctatttcgggcgggagtctctaatgcagcttatctactagaaatatttttcttagaattagataaagtatgcttgcttctattcttgggcttcggcatgcagctcgctgccttcctttgcttctttagtatcttcaggcttacgtcctgcttggtaggggcttcgataaatattgtcttcttcagggctatcttgggctcttatttcgatctacttctcttcttttcgagaggggcagctcattccttcttcagcaactctacttataagggggcatcccatccagtcctcctagatatcgtcgtcttttgcgtcctcctatctactttaaataaacgagggcttctagaacttgcggccctagagaaaattctggttcttgtccccagacttaaatctgctatctttaactaaaagttcttggtctaggctggcactaagaaggtcgatacgtttgcttccgaaggggcgggaaatctaaatcaattccaagttcntcgggggcttctaagtacggg

SEQ ID NO: 38644 - DNA, 533 bp, Neisseria meningitidis
atatacgagcatatagaaactcgtaagtcgcgcggctttgcggggccaacccaggcaattggttaaaagaacggggcaggtgattcttttcacccatacagcgttaacgcctccccggtaattcagaaccaaaggggaagtaaagacaagtaacttgcgggaaaggggcgaaagctcctagggtacatcctaggggagcttggctttgttagcttcgcagcggtcagcctaaaattctggtcctccgacctccgaaactcggtctctctcgtcctcactgtggttaactgcggcttcatcagggttaaaatctctctccctaacattccactccgcggttaaaaattcgtccataccggtaaaatccgtagcttggtcccaaggtcccctacaggcttcttctacctaactaccatccagccggtacatcctagcctggtggttcgggtttaaagggtcgctccaagcaaatgtgtccttgtcgaggcttaaactaggggcgttaaggttgcaactgctttcaatcaagtcca

SEQ ID NO: 38645 - DNA, 661 bp, Neisseria meningitidis
  misc_feature (12)..(12): N is any nucleotide
ggggctgctttntcggggtagggccggaactcaattagttagagggacaataaatggaaacggtttagggggagtaaaaattgtgaaagcagggggagcggccttagtgaaagaaaattgagtattccgggggaagaatttggccgggtgggggattaacaacatacatgctttggctgctcgtccaactcggcgtggggtgcaaagggcacttactgcggggttaaaaccaggagggggtagcgagcgatgtagaggtccgatactattgggaggacccagagaaccatcagggggggtgaaaatggttggcattggggcgcttctggttttgggaggactctcaggtactgtgcggttcatcataagagtaagaatcctgggcctagtcggttaagttaagcgggtcgtcaagaaccgccgtaccggcgtcctgaaaggagaattggtcgtgggtaatcgtgcggggaaagtgtgaatcggcaggggtttcggggggaagttggggtgcctgattggagaaattatggggctactacggataatactgggaattctaggaggggtgattctcggggcgctccgggcgctactacgaggcatagtgttgtttcggatcttgctaatgcgattgcttctaacgggcctagacctccgaagg

SEQ ID NO: 38646 - DNA, 625 bp, Neisseria meningitidis
cgatctatcctccgaatcaagttcctcacctctatctgcgtggctcctggtacatccgtgaagggccgtccgctcagggcctccatggtggccctagatcccttcaatcccgccttccataccgaaaacttcagcatccggggggtggtcctcacgggggttcaggtctgttatagtcctctcgtcagcacttctattccggtcagcctcgtggttagtagcgtcaaaactttctttgcaggcctcggcctcctgggggccgtcctcggcgttagactcaccgtcagcggtcttaacactagcctctccggcccggtcagctgcgtcaatctcttcttctcgagtacccttgtcacccgctcctccggtagcgcggtgggcttcatctctgtctacaacgttaatacattccgaaatggcttcttctgggcttctctcctccgcagccaggtcatcctcctggtctttcgcttgggaagtctcttcactctcgactccaggggtagcgttccagatcctcgcaactccgacgtccaggtcggcagcgtccctcctaccaatgtaagcttcggcctctcctacgtcggcgacaaagctggcactgccgtccgcggcgttaaggtcc

SEQ ID NO: 38647 - DNA, 675 bp, Neisseria meningitidis
aatactctcctctggctaaaagagccccaacactggcagcttcggccgcaatagagtaggaaacttctgtacctacatctgggcgtctctaagatcttactccggctccagaagcctgggaaaatccgtacaaactgccgtcgcggtcgcgggggtcttctgcgaaaatcttatctgggtcctcgccgtctctatctccagcacccaagaatccgacgtcttcggcacgggggtcggggtagaaggcgaatcaagtaaacccggcttgagttatagcctcagaaaccgtcttaaaagtataaagagagacataaattaaatcagcttcgctccaagcgtcaacttcaatatccgtaccagcttacttaacttttctaaaataatcctaaaggttacacaacgaatcattcaaggcattagcttctctataaaggtcagccgtcaactcagaaaggttgctctcgttgcggccagatctgccgtcagcggcgttcctctcgcctcctctagggctacctccgacgacgggggcgtcctaacttactcgctgcgtactatggtcggcacttctgttcattagggaagtcttaacttggcagtcaacaacgtcggcatcatcggcggaaatctttcgagtactattatctttctcggtaggctactaaataggtaaaa

SEQ ID NO: 38648 - DNA, 497 bp, Neisseria meningitidis
cgcctgggatggattgggtgacgtagcagggagtgtggccggggggtgctttaaaaaggactataacgtttggtgcggcgcacaaatgggcctaaaaagagactacagccgggcggctgcggcgggagggaccaggccccagagagagttgccggcaaaataatacggggcagagctgagccatgcgcggccctgaccaaaaaagggagcaaaaacaacgagtgctaaacatgcttagcgctacgtggggggcggcttccgtgggggcgcgtgcagcttcgtgcaactacgtgtgctatcattgggcgctcaagagggctgatatggcctaagttcgttaggggggtgtatctggagctgcattgagattttctttcagctttcattgtttcttaaaatttatcaaaacttcgcctgctgctgcggcagcctcgggcttgccggcgcctttcctcgcggggtttatcagggcgccaagttgcatcaattgcttcgtg

SEQ ID NO: 38649 - DNA, 656 bp, Neisseria meningitidis
ggggaaatagagggagggggtcgggaatacaagagagtcaggagagtacatcactgggcaggcttcccggggctgaggggggcggcgaagaagtaaaggctatcggcatgagcgtgggtgtccgaaaaagagaatccactaggcggggaacttgggtagaatcggtaggaaggttgatctgagtaccgacttaaccccaactgggaagggtaaaaacgggttaagggccaattaggaacaaagtaagaagccgattcaggttaagcataatagagtggccgagcgttagtccagaaccagagggggggtgaattgtcaggaaagtaggtgttaatggttaagaggtggtagtagtttatattttcgtagtagattagggcttaagaaagcaaggggtcgtagattttgtaaaataacgaagagggtggtgcaacggggggaatgtatatagaagatatagaagaaggaagtgttaagatcagggaccgggggagtaaagcgattcgggtggcgggtggggtgcgaagcggaggtagtcgacgaaccggtgcggcaagaaggcgtgggctttttcctaagcagacgaataaggggtttggggctggtttaactggcgatgttgagggtagtaaatgtagacatagagcgtccagaac

SEQ ID NO: 38650 - DNA, 535 bp, Neisseria meningitidis
cgtgccaggtttcttgctctcccaagcatcccgggtaacaggctacgcggcgtcccaagcatcccgggtaacaggctccgcggcgtcccaagcatcaagttagttagatccaaattgctattatcgtaggtttatccaacgcccaagtgacaagtttccccgggtacgtagggttcagacaggtttcttctcgtcccccgtgacaggtttcttgctctcccaagcatcccgggtcacaggctccgcggcgtccaatctaatgcaattcgtaggtttatcatacgcccaagtgacaagtgtcccccggtacgtagggttcagacaggtttcttctcgtacccccgtgacaggtttcttgctctcccaagcagcccgggtaacaggctccgaggcgtcccaagcatcaagttagttagatccaaattgctattatcgtaggtttatcaaacgcccaagtgacaagtttccccgggtacgtagggttcagacaggtttcttctcgtacccacgtgccaggtttcttgctctcccaagc

SEQ ID NO: 38651 - DNA, 631 bp, Neisseria meningitidis
gcttaatattcttccaagtcttatcaataaatttcttcttcgtcttattacgcttgtcttaagtcccttcctaattcttctaagatgtagtgctttctgggctttcagaggcagtaccctcgccgaaagtttttaaattcgcttcaatactttcagaaatcctctccgtctcttcagccacctaactctccgtagtttcgaagtaaattcctctagaagtgctcttagatgcagctccagggcaagcattaaagatgtcggtaatcctaaacttgctcttacggtccatctggtcgggtcctccgacggctccgaacatgctaagcttgtggctcttacgggccataaacctctagtcatcctctctatgggggtcattctcgtcggtactcataaacgagtctctagagcttcgggcatcctcctaggtttgggctctctttcagatactggcagctactctaacataattaaatattatcggatcagatgtagtaatactagtaatataaatatattaagtaccatcccagtctttcaggtaaatatgaagggtaaaggtagaagcaggttaatatgcaaaaaattaagtaaatagttaactgcttctaaattctgctcctaattcttg

SEQ ID NO: 38652 - DNA, 533 bp, Neisseria meningitidis
gagggcatggtcattcttagtgttagcgggggtaggtggccactggttgcggtggggacctccataacaaggagcaatttaaattttggttcgggttcttgcaggatttggcatcaacgaacgagcttaagtcctaatccgtacaggcgacctgggcactccggggccgggcataatccggggctccatccgggcccggtgcttctgggtccagaatacttgctggtttctgggtaaagtggttctgggaagttagggcttcgttcaagaaaatccagccagctccggccaaagtaccagggcctgcggcttcagcttcgtgcaaacttccagagtctggtacatcctaggggcaggcttcccggggctgaggggggcggcgaagaagtaaagtctatcggcatgagcgtgggtgtccgaaaaagagaatccactagtcggcgcaagtgggtagaatccgtagcaaggtttatatgagtacctaattaaccccaactgggaagggtaaaaacgggttaagggccaattaggga

SEQ ID NO: 38653 - DNA, 571 bp, Neisseria meningitidis
ggctaccctcctcggcaccttcatcctcatccggggcttcggcgtgggctcctctacccgtacgcgcttcggcagggtcttgatattaaaccagaacaccgcctcctccctaaactcgtttgctaggttcagcttcttaaacttccgggtccccctgctcttccgcaccacggccatcatccatctccggatcttcattcgcttggtcgtctctctctttgctagaaacctggtcagcttcttctcggtccctactgtggtcttcgaaacgctgggtacattgggcagaattagtaccgatctctttctcatccgtccctaccaagcgttctatacctctatcctagtcctcgactccgaacgcaccagcttcggggtccttctcttcaccaaggtccttaagctcgtggccatccgaagccgtcccctggccggcaacaagcagcccaaagcggtggcgcgtagagccgggcgttgggtcccctcctccttcggtacatcctagttcgtaggggggcgcggggaaaatcacagacaccaaaatcacgttcttcctaaaggtgatgatgat

SEQ ID NO: 38654 - DNA, 592 bp, Neisseria meningitidis
ataaaatagctacaggggcctaaacgccttcgaggcagccctccgggggttactcaatcacaaagtgtctgccatactcctattcttaggggcaagctgggaaaaactaaacctagacatctagatcttggtcagttgaaacaaattttaggcgtgcaaggcaacctataaccggggtacatcctaggtaatagttggtatccgatggatcctcaacatcccctccggtacccgctaggccaatgcggccctaggtttgagattcctactccgcgtcttctagttcttagtcctagccataaagattctgctaaatgcagggcctacctaggcccaggctttcggtttcacggtcttcgttgctatcatcatatgcagggtcagcttcgtcaacaaaaagcccttgcttcagcgggcgcaaattcctccttcaacctactactcgacctcgccgaaaacgtaaaccaaaaccttcgtgcaaaactcgggatcaacaaggcaaatattggtaccctcaaagtaggcttcaatcggggagtcctcctcctcaagaggttgcttttcgttgcaatcctaaaccctgctttcctag

SEQ ID NO: 38655 - DNA, 588 bp, Neisseria meningitidis
gttcttctaatggtccgagcttttcgttgcaacctgattctaaactttgctcttgcagcaacgatcctacaaaaaggtcctggctttcgaagcattgggagtcagatcttccctctcgagtttcctagtcctctccaacaatctccctacgtccaacttagtcctaaaaattgcgatcaatgcatctcttgctctcggttgcggggcgcgattcgtagtcctcaacctccggtaactccgctcggcctccgtctttgacctcaggatcgtaagagctgctaagatgtcattgaggtgcggagtgtttttcaacctgctctcgtgaggggcgccaaaattcttcaaaacctcctccagctcctgtaactgggccctaggatgctgcattcttgctaaaactgccatggccgtcagattcgtagtaaacaattaggccctcctctctagtcccagggtccctaaattagcaaaaatcgaaaacttcggggccaaaaataatgctatcaactctaaactagtttctggcttcagggctggggctcttcggggcattctaggagcctggatcctaaaagggtccaataagaa

SEQ ID NO: 38656 - DNA, 513 bp, Neisseria meningitidis
agcgaaaccgatggaccaaagcagaaaataaaagacggggcggttcgagttgcaactaagctggttgaaaccagggaaagagttctaaacggagggaaaaggactgtaagttatgtagcttaggaatgatcagcaataagaggtggggttggccgccgggcaaaagctacaaactaagagagtacaacgaaggcatagggaggggcaaagaatgcctaggttaaattgaggattggggctgacaaattaacacgccctgcttgcggggcagagggtacagcaagtaccgaagttgaaaaggagacgacggaagggacagaagatagaagaggatcacatggggcaaaaggggcagatggcctgaaaacaactgcaaaagcagccggccgactaattcgaccgtccaggtgtcaagttcatagggggtaatactcctagggtccaaatcagacatctcgtaaagagggggcgtccagataaagagttcattgatagtgtgctctactaaatggg

SEQ ID NO: 38657 - DNA, 408 bp, Neisseria meningitidis
cggcggggtaggagggggttggagtgcatcccaggtcccgggcgggcccaccctctcctggttctggttccctcctctctcccagcgcttgagagcgctccggtcctcggtccctccagagcaactatctttgaccagggcgtaggaagggggcttggccgtgtcctggtggttaagtatcaaactatttcttaacctaaatatgcgcttcttcctaacccacctcctccggctccccgacttctgttagatcaccaacatcctaaaaactacgagtaccagcctctgcagcaacttcgatacggctttctcttgcggcaaccgggccgtggcttcgagccgggtcgcttccatcctggcggtgggggttcttaggcttagaagctccgtgcttttcggctgcaaaaa

SEQ ID NO: 38658 - DNA, 482 bp, Neisseria meningitidis
  misc_feature (437)..(437): N is any nucleotide
aactgatgccggagagacagacagttacgatgcaggagaggcgtgtaacaaatggaaaaggtacatagggagaggaaggaacaccggggactaacacgcttcgtaaaagagaccctctagtagtcaaggtctcaaacataaatctgatcagcaatcgggtaaccagggcaaaaaacaagttagacctgagtgcaattcctagtttccgggccgcgttcatgattgcaacctcctaagtaactgcgtccggtacaaaaattaatagtactatcttgaaaattcgaggtataattgctgttggggtaaaatagggctagggaaaacttcggagaagcttcgtgcaatagtgctttcattataggagatcgcaagcgtcctacaggcggggtggggcgaaatggagaggaaaagttatggattcaggtatcttagcttcnttagtttgcttttagtgctattagttcactatatgcgtctagccc

SEQ ID NO: 38659 - DNA, 556 bp, Neisseria meningitidis
atcattctcagatcctcatcctcgctcctgtcaacgtcttcatattgcgtttcttgatagttctcatgggtgctgtctctaaggtaaatgcattcttcttcaatgtgagtaccgtaaacctttccgtaattgtcgctcttgtaatcttcgttttcattgacgtaattcttttcagggcaaagggtttatatatatcttccctacatgcaaacttggccctaaaattctcgttagaggtcagggccgctcttaagtctttagttgctgctattattttgattaagtcggtcattttcggcgtcaaagcagctctcaacttcttcttcattttcttcgctggcttcgtaaaagcatcagggattctattcctatctcggttcaatgtcgttctctttgcagcaacctcctatgtcttcctaaataacgaattcgtcgtcgtcaatgcagcctctcggggcatcaacttaataatcgtaatgccctcaactactgtcaacacctccctctctatcgtcgcgatcctcgcggtcctgataaacgttatcttaaaagccta

SEQ ID NO: 38660 - DNA, 512 bp, Neisseria meningitidis
cgctgggtcatgagtgcttgcagctgcgtctgcggcggtagcaacaaagtggttcgcttcgcttctctgggcactacagtccgtactttgggggtcctaattgcccgaggcctaggcgtgggcaggggcatccgcagccacggccgcgcctgtgtcttgcgcagggccgctagtattcgtcgagaccctcattaaactagtactatcgtccaaggcttcaaactcggggtcgtggggggtagtatcttcagcatccgtaacccctcggggtgcaataaaagccggggatttaatccagttcacgttctaaacacgggcgtgggcataggggccgtcagcatcatcattgctctcgcggtgggtatagtcggggtcgtaaatacttcctttcggggtactggtacgttctctatcgtcaaagaggcggtctttatcttcgaaactcacctccgtaccgtccgcggctccgaacgtactcgcttcatctgtcaacgtagccctcgcctccaact

SEQ ID NO: 38661 - DNA, 666 bp, Neisseria meningitidis
  misc_feature (649)..(649): N is any nucleotide
tccgtaagttaacctcataggtggacatttgcgcgcgaaagtaccccgagggggctcgccaaagtcgtaaatctggccagcaacctggcattaagtaaagattacagaaataaatgtctaggaattataggggaaaaaagtaacgggggccaacgatgcttatcgagcgaccgactgggcattcagagggctagaaaaatgttgggctgccgcaaaccaaggaggggcttaaggggaaaagagggtgcctattaaagacgataagcataaacataagtagcttaagcaggaaagtaccagactgacaagcacgtaagaatcgtaagctgtttcttctgagtatattcagaggcagcagaagcgtaggccagcgaaaaagtagctgcctgggcagagccagggtgggaggggcagggggctgtacgacagagaactatacttacgggctaagtaagcttaaaaagcttcgcttaagtagtacggcagaaggccctactgctgtactattcagaaaatcttgaagtatggtgagtattttaaagaatcttaagaggagtgctcggagttttcttaaaaagcttatatcggggggagatcttactcgtagattaagcctgcagactcttaagagagacataaactgcgttcntactagagtgacatgag

SEQ ID NO: 38662 - DNA, 633 bp, Neisseria meningitidis
gtatagcttcagcgtcctgggtgcgggccggggccgaagttcggggtgaatgggcctagaagtcggtacgggcatcctcctaaccggccccctcaaccacatcaacttccagtggatcttcgggggtggtaccagcctccgggtaaattgcggggtcagctttcaagagggcagcggtaaggtcgtaaccggtctttgggagcttcgggttctattctaaattcttccccgtaactttgtcctctagttgcttccaatccaagttttcgctgcttcaggcatccggtaaattttctctttcgggtaaagattcctcagcgccatccataccagctcttgcatcaaaacatacttcagattcgggttaggagtcctcgccctcataggagctgtcctactaaggagttccgtcaggattgctttcagattaagaggtgcaaaaatcgtcaagtgcttggctaacatctccataggattcgtcctaattgtcaacctatctgcgggcatcaacctccgatcttcaaaaagcgctaaatttttaaaagagctgagctaggttcaatctttggtctagatccctaagattggcttcatctcccaggtcatgattgtactggtcttaataattatact

SEQ ID NO: 38663 - DNA, 624 bp, Neisseria meningitidis
  misc_feature (550)..(550): N is any nucleotide
cgtaagaaaaaatactcgtactcctggcaggggccctgcgcctctctcggtgcttaaaactctctcggttactggcaaagcggtcctaattctttctgctagtagtctagttgctattcgggctcaagaccaagaacccggcagcatcctatttcggggtaatgttaacttcggctggaatattattatccggggaggtaggggcgtcaggggtaaagttcaaagacttccagccagggctcttaaagtggtcttggggcttacgggcaatcgtgctgggggcgttggggtcgggaaggtaaagggtctggtgggcttcgttcatcatattacggggattcttctagttagcttctttgctagggtggttgcaaatatctctatcttgggcattactttcgtcggaaatctcgtgatgcttcgtaaatccgaaactaacggcgaagaggtagtcggaaagcggctattcgactctaaaagagaggctccggggaactcgggcagaggcttttatcggggtctctgagtgtcccgtcccaagggagctccngtcgttataagtagaaatccctctatcctacttaagctagtaatcccaggcgtaaataaagttggtaagcttgg

SEQ ID NO: 38664 - DNA, 473 bp, Neisseria meningitidis
gacagacaggctcttaaatccaaagtctccctagtcatccctactttcacgcttaaaggcctggtaattcgagttagattggccgtggctacagcagacctctccaggggcggaagtactttcagcttcccgttggttgcatctacagacatcagcagcttctcttttgtgcgtgcgattctttgtagccttctggtaacggcaccgttctacgtctaggggtgtcacaatactctagtcattcgtacctaggtccacgccagctctcgtacaattccaggcttcgtgcaaaaaggattcatccgtactctcatcgcggttgctttcgggcttgtggtaaacatcgctagtcgaaagatcttttaggtccgtcctacctcctaccagcttatagccggtaatagggtacatagtggtatgtttagtggggttcctacatagatttaatactacgggtaaaccgggccataaac

SEQ ID NO: 38665 - DNA, 598 bp, Neisseria meningitidis
ccttgtgtcccaacctgcattctcggctactggctacaataaccggagtacaggctatggggtcagaaacctgcttcttcccctcaatatcttcttcttgagcggcttcttcttagctgtctcttgctcctccaactccgtcaacttatctttcaacgccgtacctgccctacctacactagtttctgggcctctcctagttcagcttcgtgcaatatctatatcagcagctaccaaaatcctacttgcaggcgcgcctatccctaccataacttaggagttactcacggtcgttcttagtgtaaatctcctcctcgactccagcatcaaagtcgttcggcctctcttcatcatagtcttcaatctcaattctaatgtcctccatcgggggtacatcctagtgattgcttcattcaaccttactgtcatccctcctaaagaggcgtgctatggcttcatctgggccatcaatgcaatcgttttgcttaggcccaatatcaagctcgttttcaaccttgctaactttaagatcatgcctgcagtcatgcttctcctgatcctctaaaaattctcgccaattaagtttttcactatatta

SEQ ID NO: 38666 - DNA, 631 bp, Neisseria meningitidis
ttcctgggcccgcggctgctcggggttttgcttttgctggttcctagtaggcttcataaagttcttttgaaaaattaataacttcggaggtggtacatactaaatccgggcttctaacgtaagaggtaaatgttcgtagtttaacctcgggtgcggaattcaggtaactacggtcagcggcagcaaaaacctcgaagatgaaataatacttctactaagatctaaatctaatgtccgccagccaggtaacctaagttttagtgcctatctcctcaactctcccgaaggcgcaattacaggcatactacgaagttggtcggcggcaatccggagagtcaacgtcctcctaaatctcttcaacgacgtcggcttaagttcgtccctagttcgcgcaagcctcctccaggcaggaagcttctggtccggatctgcatggtccctcggttgcggggcaagaatcctaagtgcatccctgggcagcgggtggtcccgaaacgtcgcaggccccctaaaccgggccagattgtgcagcttcaggatatttcgagttggacgtcgctgctgcaaagtaagctccctcgggccccgaaacagcgtaaccgccgggtcccgaacaataaaggccaggggc

SEQ ID NO: 38667 - DNA, 449 bp, Neisseria meningitidis
ttactggtgcgatcatcctggctacagcggctactataccccctaccagctcctccctaggctaatcctccaacctccgattggttagagctataaacctaaacctagccgctctcaacgcggttctatatctaagagctctcagggcattcctaatcttcctagtccttatcgttcggagttgatgctccctaatctacctactactctccacctctacttgggtgatcgtactgtcttcggtcctagtcggggcctctataatcctaattgtattaatatgcttcaatgcgagcaaaatcgcgcgaataaatattgctcttatcgtaatattactgttcaggttcaacgtggctgtaatcgaggtctctatcaaggatcttctcaacgtgtgaaaaatcttcatttccattcctgtaagcttcataagaggggtaatcttcggcttt

SEQ ID NO: 38668 - DNA, 570 bp, Neisseria meningitidis
gcaaaaccttcgcttcagaacttaacgcgcggggggctcgggctctgtcgtggcctccagccggcacctaagcattcgggttaatagtcaaaagcttcaacgtactcgcctcaaaatcattactactagaaagattctaaataaaattcgattcaatcctagtggtagaaatatgctccctaagatcagaaaaagtaagtttccttttgcctgtccggtaaaattcaacctcaatattcctccaaaaagtattaccttcctaactactcaaattaacaccggtagttatagaagtcgagccttccaatccaatagagttgcagtggggtttaaagagcaactcgaccgaagtagcctccaaatcttcagctgtaacctaaaaaatcttgccttgaaacttcgaagtagtcgagtcctgggaaacgatcattaaggtccgggcactaccaaacatatctttgttaggctatttcctactcgtactcaatccaggcttactctaagaaacaccagaaatacttttcctagtacagaatccgggcttggggtaagcttcgtgcaaagcttctt

SEQ ID NO: 38669 - DNA, 643 bp, Neisseria meningitidis
ttgggaatcgcttggtcaatatccgggtcttcgtctctaatactaagattcttggcttcgccgtctccggcctacttgcagaggttcttataaacctctaaagttcgtttctctagaggctaataatattctcgttacggttattaatactcgggttactactatcctcctagtcctaggcttttcttctcagcttcgtgcaaatactcaggctatccaactcctaggggtgatggttggccctaccataaaaggcagcttcagattcattatcctaattcggggcttctttcgttgcattcgggtaagtacaagcttctttaagggcgtctcgttcataattaaagtaggcccttatggaagtgctatagttaaattgaaatctcataacctctcttcatatcttatgcttctaatacctcatactcaatttaatgtagatgctccttccgtaaatatttacttaaaatgcaatagtacatatgtctttaaatccgctcattatggttcttttgcttctttttgctttggatgggctaccgcccgtatctagagccggggcgctcttggcgttcctctaagttctcttaaggttacgagtgtcgtcggctgccatctctatgtcgctggtaagcttcgtgca

SEQ ID NO: 38670 - DNA, 409 bp, Neisseria meningitidis
ctcccgggtctcttaaatcacagacgtctctacccctcctagacctcccggcagctacgccccctacagcttccgccgcgtggtcgtcgtctgcgtcagcgccgacctcggccccgtcaactccagggctgctagcatcctggctcttaagcttgctcttgcaataatcgtcaaaggcaagggggtcaccagggtcggtaatacctccagggtcttattctgaaaggttctatgcgcgggcaccagcacctcggcagaagtggtcggcggcaggggacctaagaaagtccggggtacccgtagcaggggagcgtccccctccaagcctgcaactcgcaaggagactccagagcctcctcctgcggctaaactggccaggcccgagtcgttgtaaaatgggagacgccag

SEQ ID NO: 38671 - DNA, 308 bp, Neisseria meningitidis
gttgtccagtggggggggggggctttccacatccagcgcgtctttcaaaatcgcagcggtatcgtggtattcaaaacctttcaggtcaaacaggttgcccaatacgcgcaacactttccacagcggacgcgaatcgccgaagccttgtaccacgccgtggaaggattgcagacggccttccatattgatgaagctgcctgaggtttcggtaaaacggtgcaaccggcagcaaaacgtcgaaaacgtcaagcacggtttcgctgaaaaacggcgtaaacgcaatcagccttttggccggtttcaacgcg

SEQ ID NO: 38672 - DNA, 536 bp, Neisseria meningitidis
gacgaatcggtgtggactgagatggcaaagatcgtgttgacccttaaaaggtcgcttagtggcccggcccctagcctactaacgatatcggtggtgcgtgttagcttgtccgtcctaactactaggtggctgggtccggtgctgtgtagtacccctcgtatggccatgtttacccgtgggttggtggcgtaatataaatagttgatggtgaccctcgttatagggacgttgccgctgtctaacattgtgttgctaacgttgaccctgttgaatctgccgatgacgacgatttaccccctgcctgggctcccccgtgttactaggtccccgagtgtggcggccccgttcgccgttagaaaattcgaaactaggcggatcccggcccaccctaccctcacgcgacgctttatcccaaaacccgaagacagggcgccccaaacgaccaaacaacgccaaaagcgacggtagtcgccactacgcctcctactaaccgataaccggcttagtaaacctgacacactggtcgatactgttgg

SEQ ID NO: 38673 - DNA, 584 bp, Neisseria meningitidis
gcgtgtgcgaaacggtgtaggacccggccgaccacgttgacgaaatggcgttgattcgtcggcgccgggcatgtatggatgcattgggtcgacgtattccccaacgggtagccccgttgaaatggcaacgtgttaaagttattcgttgtccccgaccacttgtcagtacaagttgaagaggtgcagaaacccctagcccgaaggttccaaacgcgaccccctacacccaaggtcccccaacccactcgcccccaatgggagggtagcacgttcgaccatacttgtactctgtgtgttgctgatagttcgtgtgacactaaaactattttctacccttcgttgtacatggatggcctgcgttccaccgaacgtggtaacattaaagcgacccgcattgtccttacagacgaaaatgccttgttgccctcgtgtggcaaaaattaaggtcgggcaatggtggaacatgggacgtcgttcgttctaatcgtcctttggacgtcttgtgaagtcctggtgggtaaatagcttgggtgtatataagaaacttaatgcccgactgggtgcctttcgtgtgtggctgcgga

SEQ ID NO: 38674 - DNA, 435 bp, Neisseria meningitidis
cctgggtaaagtaaacccccctggtaaagtaaaaattttgaacaactgggggcccctcgaacgggcgcccggtagcgattcatccctgtacggaagaattatatcactactggtgtcgagctgccctatggcttcgcctgggacgggaaggtgcgggattaatctgtcacggttgttaaatccaaatcgccataaactggcaaagttccaactaacacacctggcaacgatcgaactagctagcaagtccccactctccgaagcctcctaaacgacagagctaagttctatgagtaaccagcacgggccagtcctatgtgccattgtgtccctatattttattcactaatgcttcggctctgaatgatctcccagcgtggccaaattgtaagggaagctctactcctaggtgagccctgtgtccagacgtcccta

SEQ ID NO: 38675 - DNA, 598 bp, Neisseria meningitidis
ttgcgctaggacgctcgttcgacatagttatgttaaaaacgtggttgtgtttgtattgcgcgtgataatggtgatgcacccgttgtgcacgtgcctaaacgttgctcgaagtttcgttcgttaccttttcacgtcccgattggttgatgtcctggatactcgtatgatgggacaatcgactgtttaatggctcacttatactcgacttctcttggtactgtgcactagttaaagtgctaaactcctgagcctaaaatttcgtacattgttttgttcaccctagtaggctttggagggcaaaggtgacgagtagtgaagtgggcatgtctaacacggtgtagatggctaggtaggtaaaaacacctattatttgttgctagttcccttaatttaaatacccggatgtaactagtaggtagggtaggtaaactagtagttatattaatgtttacactgggcccgttccggctggtgtaagttagttccgtacttgtgataatacaaacactgtttatattaatacgggtaggacaaatgtagtgatgatttacgttgtgttcaccttcgcccccttgcttataccttaactacacccatt

SEQ ID NO: 38676 - DNA, 255 bp, Neisseria meningitidis
taggcgtggctcctcgtggtgggtcggcaaataaggccgagttgtttgcctgccccggctgcactccctccgttaaattaattgccgcaggtaaccctccccccgtcacttaagtcgccgccaccgttggccgcagtaacactcccaccgttcgcaacggcaatggcggacctcccgctccgaccgcggccgataactactgctttcctactggcaccccgaacatggcggaattaaagttaacgtttgcccaaa

SEQ ID NO: 38677 - DNA, 513 bp, Neisseria meningitidis
tttcagaacgggtgctattcataccgtgccaggtttcttgctctcccaagcatcaggtcccgagggtgcatccggtccctaggtttcataaccgccaggggtaaccgcggcgagacccgcgaccaccaggtcgaaaaccgcacggagacccgccgcaaacaaagctcgccaattcctcagccgaagcatccctaaagtggctccggttctttagggtacgctgggtttcagggtcatcatggtcgtggttctcttcgcgagtagtactcggggcctaatcggcccaatcctccatccggttccatccgtccgagacgcctacatgcttctcttcagcactactaagaaagtcccgcgctctctggcgctcctaaagcgcctcatagaattcttcaaacacaacttccagaacctaaaggtccccctggtccccgcggccctctccctagaagtcagcatcctcacctacgtggctcgggtcttctcgttcgaagtagcgcgcttgttctgctt

SEQ ID NO: 38678 - DNA, 474 bp, Neisseria meningitidis
cgtcgtgcaaactcctggttggccgccggaaatttagggtaagtctccgggccctaactgccgccgctactgtctcttatgtctctagttctaccgctcataccaaagaggcctcccattatgctattactgctggcggccataacttgggagtctcggtctctgccaactgcgtttaaagcggtacagacctaaccaaagtccatgctggcgtccgaaaatctgtcgctcttggcctgcaactagtctctctggtgactccttctgtctctcccgtggcaagtcatactctccatctaagtattaagagggttcctagctacgtctcgggtggtcttcttactaaaagctctctcaggggtcccgtcagcccgacctctctgagtgcggtcttcacgggccgtaactccgaatctcgcggccgattcagagcatttcaatgcggggctaccttcgtgcaaataggccttccag

SEQ ID NO: 38679 - DNA, 509 bp, Neisseria meningitidis
tgagataattcccgccttggatagcatggaaaacatgaccgaagagctgcaacactgctttgaagcacctttttacacgctcggcccgctcgttaccgacatcgcacccggctacgaccacatcacctcgggcataggcgcggccaatatcggctggtacggcacggcgatgctttgttacgttaccccgaaagagcatttggggctgcccgacaaagaagacgtgcgcaccggcatcatcacctacaaactcgccgcccacgccgccgatctcgccaaaggctggccgggcgcacaattacgtgacaacgccctgagcaaagcgcgtttcgagttccgctggcgcgaccaatttcgcttaagcctcgaccctgaacgtgccgagagcttccacgacgatactctgcctggccgaaggcgcgaaaatcgcccacttctgctcgatgtgcggccccaaattctgctcgatgaaaatcacgcaggaagtgcgcgactacgccgacaagcat

SEQ ID NO: 38680 - DNA, 453 bp, Neisseria meningitidis
tcctaccttttcttatatgctccagtgcaaaagtaaaaataccacttgggatatggagagggtttaaactttgtattgggttggcacgacgaccatcaaaacctgcccgtcatcgccaaaatcgccgaagattgcggcatcgccgcccttgccgtccacggacgcacgcgtacgcaaatgtacaaaggcgaagcgcgttacgaactcatcgccgaaaccaaatgccgtctgaacatcccggtctgggtcaacggcgacattacttcgccgcaaaaagcccaagccgtcctcaaacaaaccgccgccgacggcattatgatagggcgcggcgcgcaaggcaagccgtggttcttccgcgatttgaaacattatgccgaacacggtgttttgccgcctgccttgagtttggcagaatgcgccgccgctattttgaaccacatccgcgccatacac

SEQ ID NO: 38681 - DNA, 509 bp, Neisseria meningitidis
aagttggcaacgtcgtttgctcgtacttagcccgaccgtttgcttgtcgtggccgagggtggcaatggctaaccttgtacacctgaacgcccccctccgcctgcgaaacgttgctaggcaaggcgtaacaaaaatggtggataatagtagatagtccacggtggtaaattacatttagtgacaacacagcggaccaaacccaaattagcatagtgccgttctgttccagtctaaagagaatgacctctcaaggcgtcgaagtattaagcgaactggccttgcatcacccgcatcgctcgtggtcctgctgttccgcttcgacccaaacccaacttatcacaccctatgtccattttccgccctctaaacgttgctcgaaacaagtggtccaacacaccgcccatagcaccgggaagtacaatagataaaacgttgctcgaaacacccctagatgggaccctccacttgaaatggaccacccccgtgccctaattgtccctaacgtatgt

SEQ ID NO: 38682 - DNA, 438 bp, Neisseria meningitidis
ggctagggagagggcggcaaaccgtaggtttgcttgagcggtattttcaacatacaggctgcttttcaattcgttgaaaccgcactttagcttcgcagaaaccccccgcttccttcggaagctccgttttcagacgactccctactttttccccgccgcaacgggttctgcctttttaaacgccgccttcaactgctccgccgcttgatcaaactgcgtccgatgttgcctktcatcaggcgcagaccgccgtcgggggagaacgggttgtcagctttgcgcaggatgtcgtcgttgccgctggtttcgggggcttcgcgccattcgagtttcccgtcgttaaggatggcggcggtacggtcgatgatgaaaatccaatcggggtttttctctttgatgtattcgaaggaaacaggctgcccgtgcccctgcgttgcg

SEQ ID NO: 38683 - DNA, 538 bp, Neisseria meningitidis
acttcatgttacgttcaaaaatttaatgcactcaatatatttttttaaggagaagcaggtgagtcaaaccgatacgcaacgggacggacgatttttacgcacagtcgaatggctgggcaatatgttgccgcatccggttacgctttttattattttcattgtgttattgctgattgcctctgccgtcggtgcgtatttcggactatccgtccccgatccgcgccctgttggtgcgaaaggacgtgccgatgggcggcgcatgaagcggtgtgcgccttcgacgccgctgtcgctccattcgagggactgttcgggcggtgcggcgaacatcataaacaggcgggcggtgtccgcgccgtaggcgttaatcagttcttgcggatcgacgccgttgtttttggacttggacattttttccgtgccgctgatgacgacgggcagcccgtcggctttgaagacggcggaaatggggcggcctttgtcgtcgaacgtcagctcgacatccggggggttgatccaatctttgccgcctttgtcg

SEQ ID NO: 38684 - DNA, 485 bp, Neisseria meningitidis
gcgggttcggaaattgtgctgaaccggattatctgctgggaattgctttgcctgtttggagcgtggcgtattttctggcggttgtcctgacggtttggtgggcgtgggcaagggctaaataaatcaatgccgtctgaaaggttcagacggcattttattgtatgtctgctgtgctgcgtatcagtccagattcaatacggcggaagtgtaaacgtcttgcacgtcgtccaagtcttccagcgcgtcaatcagtttttgcattttgacggcatcgtcgccggagagttcggtttcgttttgggcgcgcatcgtaacgtcgccgtcaacggatttgtaacctgccgcctccaaagcggattttacgcccgcccaatcgtttggcgcggtaatgacttcgatggaaccgtcgtcgttggtaaccacgtcttccgcaccggcttccaaagccgcttccatcagcgcgtcttcgtcaacgccgggttcga

SEQ ID NO: 38685 - DNA, 119 bp, Neisseria meningitidis
tattcctgacgattcaggtattcctgacgattcaggtattcctgacgattcaggtattcctgacgattcaggtattcctgacgattcaggtattcctgacgattcaggtattcctgacg

SEQ ID NO: 38686 - DNA, 114 bp, Neisseria meningitidis
cgaaatttcatgccttcggcttctttggtgagcttgacgcagaataccatgcgtgccaaaacggattcctttgctgtgttcaaaaataacggggtgattttaaccgattaagga

SEQ ID NO: 38687 - DNA, 487 bp, Neisseria meningitidis
cacctcctccacccgaagaaaaaaattgatccgggtggaatggggtcggcggctggccccgttaatagtagtcccgaatcgtctgtgggtactggtgcgcccgttgtaccgggtcccacggtgtaggtgggtggcaaggtggctaatgaggccgttctaggtggtactggcccggtgcccactgttcccttgattaccactaattaggtattgacgggtcggtcgactggtacaccgccccctggcctgtcggcgcctgttggtgccatgctgacgacccttacttccgaagcgaccgcggtggtgacctaggataagtcgaatactgggtgtgctaatgttatgtcgtcggctcgtaccttgacgggtaccgcccttatgtcgtcgcctggcatggtgatggtgtcgttggccccggatgcgacggataaacctgctaatattcatgggaccgccgttgttggtcccgcccacgccgttgttacta

SEQ ID NO: 38688 - DNA, 404 bp, Neisseria meningitidis
ggatggataaaggcagccggcatttctacgcgtctgttttaatacattgcgggatttgctgcctgactgccttagcccttgctttgcgcgaaacaaagacccgtaaaccgtctatattcaaacggtttacgggtcttttttctctcttgccgttttcttcagtttgccgatccgaccacgccaccgccgattccttcaaacggtttcccgcgttcttcccacttaacgaacattaagttctgctactgctttcagcccaatgtggaaacttgcgccctgtccgaatgttgctgcgcgctttgctgaacttcctgcccttggctttcttctttgtatgggttaaacagcaagccgttttttacatagtccttgcacatcaaatccgtcacttctttcactgccgt

SEQ ID NO: 38689 - DNA, 438 bp, Neisseria meningitidis
acgccgtatattgactgcattaggcttgatggcggtaacctattcaggggtggatagattggtagcccattttcagcaggcgataaccaatagcataacgggcgcgcctcaagcgatgttgcagcttttttatataagcggcggtggaatcgttcttaatatcctgtttggcgcgatcgcctttattctgtcattcatacacctgacaaaactagcaacctcaatcgggaagaaaaaataaatggtaaagatatgtttgataaccggcacgcccggttcagggaaaacattatgaatggtttccatgatggcgaatgatgaaatgtttaagcctgatgaaaacggcatacgccgtaaagtatttacgaacataaaaggcttgagaataccgcacacctacatacaaacggacgcagaaaagctgccgatatcgacaga

SEQ ID NO: 38690 - DNA, 143 bp, Neisseria meningitidis
ttacaacacggtttctttagattttacgttctagacactagtatgaatccctgcaccgcgcaacatcgcatctgctagatccgccgcctatcataccactagcggttgcagcaatcgtacttcctgttgaatcacattgccct

SEQ ID NO: 38691 - DNA, 522 bp, Neisseria meningitidis
gcttcggctttttggcgagcggtgttggcatcgccgttttttaagatgctcaatacttgagtggcgttttgacggatttggcttaccgcgtcggcaggggcggcaaatgccatgccgatgctcaaaataccgatgcccaatgcgctgatgagggaggattttttcatgattaagtgtcctagtttgaatatgatggcatacgtttattcggcggctttttccgcattcctttgcgcttgcgcgccgcctcggcctttttggggtaagcgtcgggtgtccaaataccgtcctctttgagccgcagctcggtttgcgtaccatccatgcgggatagcataaaccgccgccccatcagaaaaaacaccgcatcgataccgtgctcgtcgtcgatcacatgcacacgcaggccaggttgccacaatacgccgtcgcgggttttatggccgcccacggttatcgtgagtgtaaatccctccagccgccagtcggccagctgctttttagcctgcttttgcaatgcgg

SEQ ID NO: 38692 - DNA, 452 bp, Neisseria meningitidis
gtcgtaaaatagccctcgaaaatcaaatgccgtctgaacatttcccgtttcagacggcatttttcaaaccggactgacgcatcgggagcaaccgcccgcaccggataaatttctgccgcagacagtttcagacggcatttgccgcctgtacaatatagtggattaacaaaaattaggacaaggcggcgagccgcagacagtacaaatagtacggaaccgattcacttggtgcttcagcaccttagagaatcgttctctttgagctaaggcgaggcagcgccgtccctcgcaatatccgtcccgcccgctgcggcggcggatacgtctgcctgcgccaaaacgggcgcgtcgttgatgccgtcgcctatcatcagcacttttttcccttctttttgcaaggctttgacgtattccagtttgtcctcgggcatggcttgggcgcggtaatgcgc

SEQ ID NO: 38693 - DNA, 609 bp, Neisseria meningitidis
gggtagtgaggcccaaaaaaagttttgttccattttgaataggctgcccttgtacttggtaaggctccgacgatgaaagatgacaccccggtaggctagctcgtacggtagatcattggtggcacggaagctggcctgaccccgggctatggcgtacactaggtcttggatcggatggtggatcggtcgtactgcgagccggccgttcggccggacccgattgtgtaatagatccatggtaaaaaacctgatgaggccctttttgaggaataagttgctccgaaaatatgttcggttgatgaacattgtaactaaagttgtgcgaaggaagatggtagtgctgctactagtgacatgtgtgcgaaagttactgaaagtacttcgttccatcattatggcgcgcatagtgatgacttcaagccttaaattatctgtgaatatcccgtaacgaaaaataacataccgttaagttaagaagtgtgcgaaaaatcgcctaatcctcctcctcggatcctccggctcgtcctgattaattgcttcgatgagaaccccatccatattaataatcggttgtatgaattcccgactaataatgcagtgattatcgaa

SEQ ID NO: 38694 - DNA, 543 bp, Neisseria meningitidis
ccaacaggtgcaaaatggtattggtgctgccgcccatcgcaatatccatcgtcatagcgttttcaaacgcttttttggtggcaatgctgcgcggtaacacggtttcatcgttttgctcgtaatagcgtttggtgatttcgacaatcatacggccggcttcgaggaacaattctttgcggccggcgtgggtcgccaaatacgaaccgttgccgggcagggaaaggccgagtgcttcggtcaggcagttcatcgagtttgccgtaaacatacccgagcgtggtcggcacgcttgccatgtttcttatcggcggcgtactggtcgcccacaacctcggccttctgcacgatttcctgcacgcgcaacactgggacgctggctgggcggagtacttcgccaacttcgttgtcgggctgctttccggttcgattgcctgcgcttccgccttgccgctgatgaatcgtttcggcaggcattgattcctttttcacataccgatgccgtttgaaagatgttcagacggtatcttccgaaccagacagatg

SEQ ID NO: 38695 - DNA, 103 bp, Neisseria meningitidis
ctactagatgaaaacatagaggtagaatttcatgacatcagcatgggcaattatattttacacatgaccctaaaagcacaggcaacaaaagcaaaaatagaca

SEQ ID NO: 38696 - DNA, 389 bp, Neisseria meningitidis
gctcggtacaccaggaatggtcagcaacttcacagaactcctagtgccaccttcctttttgaacttttatgacttctggacagcgtcatgatgattgtcaagtgtcatgacaccagtggaagtgtctttttttcacatcccctttaaccaatgccactgcgctgcctgcgataatctgcgagtaggctatgactttttggcgttcttggggtgacagtttgcctacatcgcgtccgtccaacagggtttctcccaccatctcgccgactgccgcgccgattgcgccgtctcgacatttgcctttatttgctaccgccgatgcacagcctgctacggcatgcgctatcttgtgggcaatgtagtcttcgctgagattaagtttgattttg

SEQ ID NO: 38697 - DNA, 417 bp, Neisseria meningitidis
atcgcccgtctcaataaccaataagcctttgctctcgatccgaccaccattggagataaatgtgcctgccgctcctttttcggtggtttcgatggagagataagtcggtgaagcttcggtgccgtcggcagtggaggcgatgcggccgctgttttcaatgcggactgacgaagtcacaagcaattgcttggccgcttcgagtgtgacggcatttttgacgcctacgcctttttcattggcagtcagtgtgatgctgtcggcgtacatagcgcccagtgcggcagtatcaaaggcaatagtcggtttcgtacccgctgcagtacctgcactgatttcgccgctggcgtaatctactttctgaggaccggtagaaaccgccaggtttttaccctgtaatttcccctgcagagcaactgc

SEQ ID NO: 38698 - DNA, 548 bp, Neisseria meningitidis
caactctgcggatggggcaggtaactatgttgcccctatttaaaaatttgttgtgttgtgtgagcagctattggcaacggcgcctgtgtttcgctttactagcctggccattaataactttgcttttaccctccctagtaggctggaccgtgccctgcgtgcacggcctaaacataggccgcgtgtgttgttggtgccgtttgcggctcgtacattgagcccgtgtgtgtcgcaatcgtcgaggaaacagttcctgataacgttgccccgaactatgaagtgtggcgtggcggtaatgttccttgtactaaaacagtcgtcgtggaaagagtgggggacgcgtggcctcctgtgtaggccgaggaaactgggtaggatccccccgttgacgtcgctgactaggaaatcgtcccggtggcagagtgtgttgttggagagcgtgttgatgaggcgcttgacaagattgtttgaaatggcggcactgaagaggatggggcagtcgttcgctgggacgtcgtggtcgttgagctggtgtaaagcctggtggg

SEQ ID NO: 38699 - DNA, 238 bp, Neisseria meningitidis
tttcgatgctgccttcaaacgcgccgataacacggctggcgaggaaggcggtgcagaggttgacggcgagccacatccagcggtttttcaccgaatcccacacgggggcgaacaggtcttcctcttcctgcaaacccgccatattcagcatatccgcttccgattcttcgcggatcacgtccaccagctcctcccggtaaagtcgccgtattcggtcttttgaagcgaaatggtaagg

SEQ ID NO: 38700 - DNA, 437 bp, Neisseria meningitidis
tattttatcagaatgccgatgcttgttctgtttcaaattaatttcttttcaaataaattacttattcggatttgccggggctttcggataaattccttgccaaggtgcggcattgcctgcataattcgctttctttgccgggatagctcagttggtagagcacctgacttgtaatcaatcaacaattccggcgtttccacgtcatgtccggcaatatgggtggcaaagttgccgccgctgtaggagatgaagcggtcgcggtaaagttcgacggcgcgagtaacgtgcggcccctgcccgaatacgacatccgcgccggaatcgacggcaagccgcgcaaactcaacgacgttgcccctgttttccccatagaagatttcggtatcgaacggcaggtgttccgcctgtttcccttccgcgccgccgtggaacatcac

SEQ ID NO: 38701 - DNA, 602 bp, Neisseria meningitidis
cgaaaatgaaacgggtaaaacacaaataaggcctgtatgcaggcaaggtttatttgtgtttgacccggaaacgggttcagacggcacgaaccgggatgccgtgccgtctgaaaggggtttatcgggtggcgcggtaatctgcgtcggctttttcaaagcgttcttgggtttcgcgcgaaggttctttgttgaacagggaaaccaacacggcaacgatcaagcaaacaataaagcccggcacgatttcgtacatcgtcaacaagccgctttctcctgccgcttgagccggttttttcacccattccgcccatacgactacggttaacgcacctgcaaccatacccgacaacgcgccgtaggcagtgatgcgtttccacaatacggacagaatcacaatcgggccgaatgccgcgccgaaacctgcccacgcgtaagacaccagtcccaatactttgctgttcggatcggaagcatcaggatggaaatcacggcaatcgccaagaccatcaggcggccgacccataccaattccgactgatgcgcgttaatacgcaaaaagtctttgtagaagtcttcggtaatcgcgctggagcaaaccaaaa

SEQ ID NO: 38702 - DNA, 593 bp, Neisseria meningitidis
  misc_feature (514)..(514): N is any nucleotide
gcttgccgcctatttttctacgcgcaatttcgacgattatattttgggcgggcgcagcctaggcccgtttgttaccgcgatgtcggcaggcgcgtccgatatgtccggctggcttttgatgggtctgccgggcgcgatttatttgagcggtttgaatgaggcttggattgccatcggcctcttggtcggcgcgtatttcaactggcttttggtggcgggccgtctgcgcgtacataccgaatacgccaacaacgcgctgacgctgccggattatttcttccaccgctttggcgcgggcggacacttgatgaaagtggtttccgcactgattatcctgtttttcttcacgatttattgcgcctcgggcattgtggcgggcgcaaccctgttccaaagcctgtttgaaggtatgacttacaatcaggcaatgtggctgggcgcgggcgcgaccatcgcctataccttcttgggcggctttttggcggtaagctggacggatacgctgcaggcttcnttgatgattttcgcgctgattttaacgcctgtgatggtctatctgggcttgggcggcgcggaacagatgtctgccgcga

SEQ ID NO: 38703 - DNA, 270 bp, Neisseria meningitidis
cctaaggcacatgtcattatccccattcgataggtgaggacactgaggttcagggaggggagacatcttgctcctggacacctcagctggggaggaaggcagtggcgatcattcttaggaatctccgaccgccatgggctcctgctctgtgcaccctcaggagcttacggtctggttacaaaaatgccatctgcctatgctgaattctaggcttatgaagatccaagacatattcctgaaaatccatattttcatgcattgtactatctt

SEQ ID NO: 38704 - DNA, 389 bp, Neisseria meningitidis
gaacataccaattcgaaaacatcaataactcaaaaaagatttctttttatgatcaagaatataccgaaggttacctagttggcttcgcccgaggtttaggggttgcaaaaagaaatggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaatttggtatgtccgatgtcgcccgtt

SEQ ID NO: 38705 - DNA, 413 bp, Neisseria meningitidis
cagcatcatcgacaataatgctacaagtgtgcagggtttcgttttgtgcggcggtttggggcattgcattcatggtcattttcctgattctgtcgtgtgttgccgaatcgggcgacctgtgtgaaggtaacaaaaaagccgccccgttttcgagcggcctgttttgcgtatgggatggatttcaagcaagcgcaaaaaagtaccgcacgtctgtgtggtaccaatagcaataagcggttgtaaattttttgccttgcatgatgaaatgccgtctgaagataaaaatattggggagattctaaatcaaaacgctgccgcgcctcaagcattttatcgaaatttttttgatttttcatctatccgattgaaaatatttcggtttatttttaccgctgcccgatattgtcggcaat

SEQ ID NO: 38706 - DNA, 664 bp, Neisseria meningitidis
  misc_feature (29)..(29): N is any nucleotide
cggattcccgcctgcgcgggaatgacganctcttccgcatctgattttggacctcttgacgcgatttgctgcattttgaagtgtccaccaagataatcatagtaaaaaaatcgtccatcagctgttggctgatgttgagaatattgatttggttttccgccaaaattttggaaacatcgtacacgatgccgacgcggtctttaccgatgacggtgatgactgaattgttcacaggcttactccttgcagatatccgttaaagtccgaaattataccaccgttggattttgaagaaatattgtcaacaatatatacatacaaaatgccgtctgaaactatttcagacagcatcaagattcagggttcgattaaataaccatccttatcccactgggttttcctgaccaacttgtcatcctgataaacagcttcgctctttttagaaccatcttcataccactccaaaaccaccccgttgcgttgatggtggcggatagacagttccgagagtaatcggccgctttcatcccaagtcagaattttggcaggctcatcgttgaccataaccatttccgtcttgatactgccgtcggcataccattgctttcatacgccgtttgccttattttgcttaaactggatttcgctttccttgccgccgtta

SEQ ID NO: 38707 - DNA, 519 bp, Neisseria meningitidis
cctacaaacccggccgccattcactcgcagacttggctaagtcggatattgaaaatcgacagccgaatttcacagggccgcgtgggacgaaggtttgaaaggctatgcccgcctgcgcttcatcgtcaacgccttcacgcggatgcgcgccctgacctttaaaaacgaactggatttcgactacaaatccacagtgaagaaaaatgccgccttacctgcgcccgtggttcaaagcccccgaccggcaaaacctcgaccgcaccatcatcttcggacactggtcctcgctgggctacacgaatgccgacaacgtcatctcgctggacaccggcgcgcggcaaatgcttccgaaacagctgttaaaaataatgcattagatattatttgggatattggcaacctcgtatgggacggcggtaaatggatttacgccaaatctattggcgataagcagatggctcgagaagcggcgattgattttggtgtggatgccgccgcagctgccgttccctttgttcc

SEQ ID NO: 38708 - DNA, 628 bp, Neisseria meningitidis
agcgggaaggtttaaatagttaggacgccggtccagaagtagttactacccaaagaaagtgcaacagtctatcggctgagctgcttcgtgtggaagacgcaatggggtctaaactcacaattgaagtcgtggacgttggcccattggtacggcaggggagtgcctcgcaggtcgacgaaggcgtaccgcaaagcgcgtcggaggcactagaagcgtgaacgccgatacgagcagtgacaaagtgggcgaaaagtttgtctgttgaaagtttaaggcccttcgtgtaatgcctactggtgcakggcgagctggttttcaaggtgaggtagaaacgtgcagctgacgggaaataggccaacaccttcgcatccgacctaaacgtgacgcggggatggagaaggccaggccggtaagtcgccggaacagtccgcccaagttggcaggcggaagatccaggtaaacttgggctcctccaatattgagaagcgatgatgagcgctcatggatatgaagtaattgacattatgtccttaggaaaagttatcaagtcctagcccgaactgaattgcattgtarattgatataggcgggtaggacgagaacctcaaggtgtccgagagaatctagg

SEQ ID NO: 38709 - DNA, 642 bp, Neisseria meningitidis
  misc_feature (627)..(627): N is any nucleotide
ctatccgaaccgctgccgccctccaagtaatcattaccggcaccgccgatcagagtgtcgttaccgtcttcgccggctgatgtgtaccaaaccgtctttgcccggcatcacgctgacaatcgcgccgacattgttatcgaggattttcaccacagtgccttcgtacactttgcccacttccacttcggcagtaatctgctcgatgcgttttttcgccgcatcgccggcttcttgagtggttgcggcaatggtaatcgtaccgtcttcggcaatattgatttccgtaccggtttcagcggtaatcgaacggatggtttcaccgcccttaccgataacttcgcggattttgtcttggttgattttcatcgtgaacaagcgtggcgcgtgtgcggacagctcttgcgggcccgcaacggcggctttcatctgatccaagatgtgcagacgcgcttctttggcctgtgccaaagcgatttgcataatttctttggtaatgccttggattttgatgtccatttgcagcgcggtaacgccttcggtcgtaccggccagtttaaagtccatatcgcccaagtggtcttcgtcgcccaaaatgtcagtcaggacggcaaatttgttgccttccanaatcagacccatcgc

SEQ ID NO: 38710 - DNA, 230 bp, Neisseria meningitidis
gcctcgccttgccgtactatttgtactgtctgcggcttcgtcgccttgtcctgatttttgttaatccactataaaagagggcgtctgaaaaacatttttcagacgggcttgtttattcaatcaaattagtctttcaactttggcaactgattttaaacttttgccattttgccttccaattccgccaaatcgggtttgcctttttcccccaaattcccagggggtttttc

SEQ ID NO: 38711 - DNA, 584 bp, Neisseria meningitidis
  misc_feature (490)..(490): N is any nucleotide
aaacgtcctacacatccttttagtgcaatttcgcttaaatttgttaaacttggtagggcccttatcttcgaaaaattacctcttgttaatatgttgtgtattgttgtgtttcgactgaaattgcgccttagtaacaaaaaattgttccttgttaaatggctgggtgtgttccgtgttaaggcgtggacgtagtccaggttgctcgaaaagctggctagtgtgacccgtggtctaaattgtaaactgttccgtaataaacgcccactgttgcccctgacacagggtgggccggatatgacgacgctttaccctttcctagatggtacactggcgctgaattatgaattgcgcgtaaacctgatttgtgtgtttaaacttgttgtacccccttgtgttgccctaagggtgggtgggtcgacgctggacgtgtgtataaatgtactggggtgcctgagtgtgatggccatgggaattgtgttgtcgtttgctnttaaactttatatgtgtttgcccctgggtaggtgtgttaacatggtcctgattaaacgcctggccctggggtgtggaactagtatgtctggacc

SEQ ID NO: 38712 - DNA, 620 bp, Neisseria meningitidis
gggtgcatgcttaagaaaattattgttactagtgtgattaagattaggtcgaacccgctgacgggggtgatccgtgaggtgccgtttagccgtagggtcccaaaacaggtgagttaagacgtgttggcagtaagattggacaggacgaggaacgcttagccgtgttttgcaaagttgcctatatttcgttacccgttggcgcaggccaaaaataacaataaagtggtaaggacgattaaggcgtggacaaaggcggtgaaactggaactcacatttcgcaaatttaccccggtgaaaacagtggctaacgaggtgaagttcgttgacgttaacgtttaaaatagttacgtgccgtcgtttacgcccctcttccggaccgcgaataacacgaatggcacccccgccgtcgtgctaaaaaccctatcgtgggcccggcgtggacaatgccacaacacgttcgacaccacccctaacttattcgcccgctgttcgacgtccctagatggtacgctttcttctaccctcaaaggaaagctacgagtcctaaaattgacgttgaaactgttaaacttcttattacgtgtttgaccggtgaaacccgttgttaagtccggctcgaa

SEQ ID NO: 38713 - DNA, 525 bp, Neisseria meningitidis
gctgtaaatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtgcgcgggcgtgggcggtcaggctttcgccgtgtgccagcacgctggcggtttcgcctaatttttgcgcgccctgttccgaaacctgaatcaggctggagcgtttttggaaatcatatgtccccaaaggcgaggaaaagcgggcggttcggctggtgggcaacacatggtttggaccggcgcagtagtcgccgaggctttcgccggtgtagcgtcccatgaaaatcgcaccggcgtggcggatttttttcgcccattcctgcgggttttcgactgacagttccaagtgttcgggggaaatgtagttggcgatttcgcaagcttcgtccaagtctttggcgagtatcatcgcgcccctgttgccgagcgaggcttcgatgat

SEQ ID NO: 38714 - DNA, 315 bp, Neisseria meningitidis
acaagaagctggtagctccaccgcggtggcggccgctctagaactagtggatcccccgggctgcatgaattggcacgagctcgtgccgaattcggcacgagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcatcccagccctg

SEQ ID NO: 38715 - DNA, 397 bp, Neisseria meningitidis
tgggtacccggccccccctcgaagaagaaggtcaggtacatgaaagacacgtccacatcacagttgcccccaaactgcctgtgctcctcgatggtgtctctccctccagaaaacgcatgcttattgaccttggttttgatctgcttggccgtgtcggtgaggaagatggcggagttggggtcgctgggactcattttggtctgggcgacctgcatggctgggaagaaggtggagtgcaacacggctggtttacgatacccgatcctgtgggcgacgtcgcttgtcattctaaagttaagatcctggtcaatggcacatgggataaggcactggatatccgtcctgtctcggaagatctgtgggaatagattgctgaatgatggagcatcctgtatgg

SEQ ID NO: 38716 - DNA, 563 bp, Neisseria meningitidis
cttgcccgcaaaaacgtggcgtgtgcacccgtgtatacacaactaccccgtaaaaaacctagtgagttagcatcatattgctgccatttttcacggtctttccctaaataagcagtaaaggctttttctccccacggcacgaggcttggcgataaaataggcgaaaaggcagaaacactttgataacgttcctgattccgcagcgccaataccaatgcgccgtgtccgcccattgaatgtcccataatggaacgtttgccgttggtaggaaagtgtttctcaatcagacggggtagctcgttcaaaatgtaatcatacatttgataattcgccgcccaaggctgttcggtcgcattcaaataaaagcctgcactctgtcctaaatcgtaagcatcatcgttcggcacttgctctccgcgagggctcgtatccggggccatcacaattacttgatgttctgccgcataacgctgaaagctgacttggtaatgcaattttgttccgtacacgtcaagccggaaagccaataaatcacaccaagcggtcgattttctggattatct

SEQ ID NO: 38717 - DNA, 212 bp, Neisseria meningitidis
ggctgaaaatcatgcaggacgggtaatcggcggctttgacggcttctgcccaagccaccaaggattcatcggtgtcgcacagccgccatacgtccatattcggaatcaggcgcagggtagcggtttgctcaatcggttgatgggtcgggccgtcttcgcccaaaccgatggaatcgtgggtaaacacaaatacagggttgattttcatcaac

SEQ ID NO: 38718 - DNA, 625 bp, Neisseria meningitidis
ctgtggtgtgggtgggacgttcgttccccttggacccagaggcaaatgaccctgttatcttgtttcccgtccctggtatccgtttattagataaacgtgggtagtatgcttttgcagtccccgtgcctgtccccggtcctgtttggacgggacccgacgtgccgtggggaaccgacggggttggggatgaggatgccggtgtgtaggccgttgaagtgcctttacctgctggtggtgatcccgtataggcagcctaatgtggtcccggatgtgttgaagttgttttagcaggtcccgggcgccctgttgcggtccctgttgatgaagacgatggatgtgctgggtgatcgtcctagtagtgggaatagggtgtgggctagttttacaggcgtgatggcgccgacgtggcaccggccgatttacctggtgatggcccggaaacttagtggtgagagggtgcaaaaacagttggtgtagcggatgacgttgcttagcccgttccgtgcggtcctggtaacggcggtggtgaaacgcctaaacctccccctccttgtgtcaacaaggctaaagtagacggtgaacggcctggggcacttggtcctgataactgtgctacatatccccc

SEQ ID NO: 38719 - DNA, 616 bp, Neisseria meningitidis
tttgataaggaaccctgtcattccaggattgccacagccatggttgttgcccatcggggtcctgacttgacgtctctatactcctaaccaattccttagtattgggtaggtgctatatttcacatgcttatccctgcgccagtagagcgtcgcgcccccaacaaatagctgtagttattcacctctcgtgatttcttggggtccatggagtaagcttccaattccagagggtacattcctctttgaagccatggcactaacccgttgagccttcctcttcgagcctctctaagtgttccagaacctctacttcgtttattcgcgctggcccgtggcatggcctgacctaaatcgaagtccagcggtccccttcggaagtgcggcactggccgtcctgcgcttgcagatatctgctgctatcctctggcgccaagaagatttggacccgttcaagctccttattcattggtccaaataagtcaccttaatagtccgttaattcaattcctcttgcttttatactgtacccgaactaagcataggaacaccaattcgcccttactgatcatgtaccctcgttctgttccaggggttgatctatttcatgttgacgaat

SEQ ID NO: 38720 - DNA, 609 bp, Neisseria meningitidis
cgtgtgttgctggcttgacctcgttggaatataagttgtaccattcgacgggtgcaggtatgttggaagattctgcgcatggtgcggtatatggtactgacacgcctgatcgtgcgacgtttatttgtaacgtatgtaatggtcggtcgcccatttgccctggtgacccgaaaactaaaaatgttaaatataagtctgataagtgcttgacagatgaaagtcgtattcgtcatgttcgttaaaatcctagttgtgttcattcgtattactcgtattgtattggtgaaactccgggtgtatagccgaatattacttataactcgtaccctcattaagctaccacggtggaaacgtgtgaagttgctgaataaggtaaacccgttgatcggtaggtgtgaccttatgaaaattgtgtatgtggtatagatcgacctttcgtaacgttgctcgaagttgtcctagatggtaccccgttgtcccatttcatttgtatcaccccctagaaattgactacgtccttacctcccttagaatttctttcccttcacatgtaataaaattgcattgttgccccgtcgccgaattctggtatgtttgatgtgttgattg

SEQ ID NO: 38721 - DNA, 450 bp, Neisseria meningitidis
aggatccccacgaacacaaaatgaccgtacagaccaagacaaaaggtttggcgtggcaagaaaaaccgctatccgacaacgaacgtctgaaaaccgaaagcaattttttacgcggcacgattttggacgatttgaaagacccgctcacgggcggcttcaaaggcgacaacttccaactcatccgcttccacggtatgtatgagcaggacgaccgcgacatccgcgccgaacgcgccgaggcaaaactcgagcccttgaaatttatgcttttgcgctgccggctgccgggcgggatcatcaaaccgtcccaatggatagaactggacaaatttgcccgggaaaacagtcattaccgctccatccggctgaccaaccggcaaaccttccaatttcacggggtgccgaaagccaagttgcagacgatgcaacgcctcctgcacaaactgggtt

SEQ ID NO: 38722 - DNA, 441 bp, Neisseria meningitidis
cctactctccctaagcaacgagatgaaacagcgtatcgactccctgccggttgaattttccgaaaaaacgcgacgtaaccagcatcaacatatataagaacagcacaactagcatcaatacatcaggcaacgaaaatgcagaataatgcacttaatggtgtttggatatctgttgttttgtgctgttagtaattcatctttctgtgtttacagtttagcagttgtacagttttatagtaatgtttaaacaatgactgatttattttaaatgcagatattgtcgaggataaacatggccaaagccctttcagtaacatttctgattttttagcgagccttctcatttccccagcgagatcggtactggtacctgtactttggccgccgatatgcttaagttcagtaaccttagcgcgcaaatccagtaaccttacgttacgt

SEQ ID NO: 38723 - DNA, 655 bp, Neisseria meningitidis
  misc_feature (436)..(436): N is any nucleotide
caccaacctatgtgtcgtcctgatctgggaggagttgtccctcccaaacaaatctgattctaccgccccgaagagcggggtttcaaccgacaaggaagattgatgaacaatatgtttgccgcaaaattgtccaaactggtttataccgcttccgaccatcctgattccctgtcggagatggaggagtttgaccgcctgattctgctgatacgcaaactgtatcaaatattggacgggcaacatatcctctccagagtaacggtttgccttcaccaccaaaaccggcgcgacctgattgccttggataaagcggctgccggttgcgattcggcaatgttgcgcgcccaacgttggctcggacgacatggtcgccgccataaattcggcggggtagtgcgctttaagccatgcggtctggtaggaaatcagggcgtangcggcggcgtgggatttgttgaaaccgtagccggcgaatttttccatgtagttgaagatttcgtcggatttttcgcgcgaaatgccttgttttgccgcgccttcggcgaagatttcgcggtgtttcaccatttcttcgggttttttcttacccatggcgcgacgcagcaggtccgcgcccgccgaacgagtaaccgccggataatttgcgccgcctgca

SEQ ID NO: 38724 - DNA, 644 bp, Neisseria meningitidis
tatcgcattgtaaaatagtaaacaaagtaaagtttgggcggtggaaccggcagatgtgtcagtcctaggcgtcagcacttctatgggcgcggaagcctgagctcctctttgggtattaaactaaacgtcccgtcccaccctaacacccagaccgtttgggcggtggaaccggcagatgtgttagtcctaggcgtcggcacttctacgggcgcggaagcctgagctcctctttgggtattaaacaacaaaccactttgaccgggacaacccttgttaccagagaggcggacgagcggcccaagctgtatgttcggaaagtgcgcacatgcgaacagtgcactgagggcctgaactttccttctctcgttaaacataaactttaaatccccatggcccgggaccccccaccacctaaataacaaccctaccgggaaaatttgccaccgctcacaactgctactaattgtccataatcacttgccattgccccccgcggcacgccccgtggcacgccccatttctccttctagttcgcaaggatctaaaaggtgcaccttcctaaatggtaccgcctgatacgtcgttgggaagttgaatttgacattgaaatgtgatggggtgacacattgtcggaaaaacggtgg

SEQ ID NO: 38725 - DNA, 386 bp, Neisseria meningitidis
catgttggtgttctcattcagccctttctcccaagaatggtaaggacgacaggcaacggacggtaaacgaagagcttgaagagttcgttcaactcaatcgaatccgcccccgttttcaacacccaaccctgtctgccggaatagatgtagccgtgccgcgccagcttttccaaaagctcgcccaactcgtcgtagcccatattgatatgccgtctgaactcctgaacaggcaaggctttgccttctttttgcgccgcatccagaagcagcaggattttcaacacgtcgtcaaaccgtccgcgcgagtcgaagcccctgcggaacgcttctccctgccagtaggagagtgaagaagtcagcaccgcgccgcccaagaccagcgtcca

SEQ ID NO: 38726 - DNA, 659 bp, Neisseria meningitidis
taaggcaaaaacaagcgttttcgtcattttgaggcgtgtggattattccttaggtattttcgggccggagaccaacgaggtggcgggtgtcgtcggtacgtccggagaccaaaataactttgccagggatgttggtttcggcggtcaaaaaaagtagcgtcttaatgttttccatttaaacaaatgtcggtgaggatgcggttgtttaaaacgatttgcatggcgttgtgcagttgcagcaggtaaacggtcggggcggcgagtccgatgaggacgcgttcggcggtggggtggatgcggaagcggtgcatcagtgcgttgttgttttggagccggccgttcattttccagttgccgatgacccatttttgatcccacattccgatttggcgatacatcttttttgctccgtgtcgtgtttttttgtctgccgcgtgtggcgcggtgcaacgtgaagtttagtggatatgcggcgggttcgcaacttgaagcggccggccgggcggtttggaatgttgtttcgggcaggctgttttataatggccgcctgatatgtatgcaactataggagatgtgatgcacgcgcttcatttttcggcttcggacaaggccgcgctttatcgggaggtgttgccgcagattgagtctgtggtggctga

SEQ ID NO: 38727 - DNA, 459 bp, Neisseria meningitidis
ataacgcggatttgcggctgcttgatttcaacggttttcagggcttcggcaagtttgtcggcggcgggtttcatcaggctgcaatgggaaggtacggacacgggcagcggcagggcgcgtttggcaccggcttctttggcggcagccatggcgcgtccgacggcggcggcgttgcctgcaatcacgatttgtccgggtgagttgaagttgacggcttcgaccacttcgctttgggcggcttcggcacaaatggctttaacctgctcatcttccaagccgagaatcgccgccattgcgcccacgccttgcggtacggcggactgcatcagttcggcgcgcaggcgcacgagtttgaccgcgtcggcaaaattcaatgcgccggcggcaacgagtgcggtgtattcgccgaggctgtgtccggcaacggcggcaggcgttttgccgcccgcttctaaatag

SEQ ID NO: 38728 - protein, 152 aa, Neisseria meningitidis
ITRICGCLISTVFRASASLSAAGFIRLQWEGTDTGSGRARLAPASLAAAMARPTAAALPAITICPGELKLTASTTSLWAASAQMALTCSSSKPRIAAIAPTPCGTADCISSARRRTSLTASAKFNAPAATSAVYSPRLCPATAAGVLPPASK

SEQ ID NO: 38729 - DNA, 459 bp, Neisseria gonorrhoeae;
atgacgcggatttgcggctgcttgatttcaacggttttgagtgtttcggcaagtttgtcggcggcgggtttcatcaggctgcaatgggaaggaacggataccggcagcggcagggcgcgtttggctccggcttctttggcggcagccatggtgcgtccgacggcggcggcgttgcctgcaatcacgacttgtccgggcgagttgaagttgacggcttcgaccacttcgccctgtgcggattcggcacaaatctgcctgacctgttcatcttccaaacccaaaatggccgccattgcgcctacgccttgcggtacggcggactgcatcagttcggcgcgcaggcggacgagtttgacggcatcggcaaaatccaatgcttcggcggcgacaagcgcggtgtattcgccgaggctgtgtccggcaacggcggcaggcgttttgccgcccacttccaaatag

SEQ ID NO: 38730 - protein, 152 aa, Neisseria gonorrhoeae;
MTRICGCLISTVLSVSASLSAAGFIRLQWEGTDTGSGRARLAPASLAAAMVRPTAAALPAITTCPGELKLTASTTSPCADSAQICLTCSSSKPKMAAIAPTPCGTADCISSARRRTSLTASAKSNASAATSAVYSPRLCPATAAGVLPPTSK

SEQ ID NO: 38731 - DNA, 459 bp, Neisseria meningitidis
  misc_feature (1)..(459): N is any nucleotide
atgacncngatttgcggctgcttgatttcaacggtttnnagggcttcggcgagtttgtcggcggcgggtttcatgaggctgcaatgggaaggtacngacacnggcagcggcagggcgcgtttggcgccggcttctttggcggcaagcatagcgcgctcgacggcggcggcattgcctgcaatcacgacttgtccgggcgagttgaagttgacggcttcaaccacttcatcctgtgcggattcggcgcaaatttgttttacctgttcatcttccaagccgagaatcgccgccattgcgcccacgccttgcggtacggcggactgcatcagttcggcgcgcangcgcacgagtttgaccgcgtcggcaaaatccaatgcgccggcggcaacnagtgcggtgtattcgccgangctgtgtccggcaacggcggcaggcgttttgccgcccgcttccgaatag

SEQ ID NO: 38732 - protein, 152 aa, Neisseria meningitidis
  misc_feature (1)..(152): Xaa is any amino acid
MTXICGCLISTVXRASASLSAAGFMRLQWEGTDTGSGRARLAPASLAASIARSTAAALPAITTCPGELKLTASTTSSCADSAQICFTCSSSKPRIAAIAPTPCGTADCISSARXRTSLTASAKSNAPAATSAVYSPXLCPATAAGVLPPASE

SEQ ID NO: 38733 - DNA, 600 bp, Neisseria meningitidis
tccgttatcgggcgtatggagttggacaaaacgtttgaagaacgcgacgaaatcaacagtactgttgttgcggctttggacgaggcggccggggcttggggtgtgaaggttttgcgttatgagattaaagacttggttccgccgcaagaaatccttcgctcaatgcaggcgcaaattactgccgaacgcgaaaaacgcgcccgtatcgccgaatccgaaggtcgtaaaatcgaacaaatcaaccttgccagtggtcagcgcgaagccgaaatccaacaatccgaaggcgaggctcaggctgcggtcaatgcgtcaaatgccgagaaaatcgcccgcatcaaccgcgccaaaggtgaagcggaatccttgcgccttgttgccgaagccaatgccgaagccatccgtcaaattgccgccgcccttcaaacccaaggcggtgcggatgcggtcaatctgaagattgcggaacaatacgtcgctgcgttcaacaatcttgccaaagaaagcaatacgctgattatgcccgccaatgttgccgacatcggcagcctgatttctgccggtatgaaaattatcgacagcagcaaaaccgccaaataa

SEQ ID NO: 38734 - protein, 199 aa, Neisseria meningitidis
SVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 38735 - DNA, 951 bp, Neisseria gonorrhoeae
atggaatttttcattatcttgttggcagccgtcgccgttttcggcttcaaatcctttgtcgtcatcccccagcaggaagtccacgttgtcgaaaggctcgggcgtttccatcgcgccctgacggccggtttgaatattttgattccctttatcgaccgcgtcgcctaccgccattcgctgaaagaaatccctttagacgtacccagccaggtctgcatcacgcgcgataatacgcaattgactgttgacggcatcatctatttccaagtaaccgatcccaaactcgcctcatacggttcgagcaactacattatggcaattacccagcttgcccaaacgacgctgcgttccgttatcgggcgtatggagttggacaaaacgtttgaagaacgcgacgaaatcaacagtaccgtcgtctccgccctcgatgaagccgccggggcttggggtgtgaaagtcctccgttacgaaatcaaggatttggttccgccgcaagaaatccttcgcgcaatgcaggcacaaattaccgccgaacgcgaaaaacgcgcccgtattgccgaatccgaaggccgtaaaatcgaacaaatcaaccttgccagtggtcagcgtgaagccgaaatccaacaatccgaaggcgaggctcaggctgcggtcaatgcgtccaatgccgagaaaatcgcccgcatcaaccgcgccaaaggcgaagcggaatccctgcgccttgttgccgaagccaatgccgaagccaaccgtcaaattgccgccgcccttcaaacccaaagcggggcggatgcggtcaatctgaagattgcgggacaatacgttaccgcgttcaaaaatcttgccaaagaagacaatacgcggattaagcccgccaaggttgccgaaatcgggaaccctaattttcggcggcatgaaaaattttcgccagaagcaaaaacggccaaataa

SEQ ID NO: 38736 - protein, 316 aa, Neisseria gonorrhoeae
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRAMQAQITAEREKRARIAESEGRKIEQINLASGQREAEIQQSEGEAQAAVNASNAEKIARINRAKGEAESLRLVAEANAEANRQIAAALQTQSGADAVNLKIAGQYVTAFKNLAKEDNTRIKPAKVAEIGNPNFRRHEKFSPEAKTAK

SEQ ID NO: 38737 - DNA, 948 bp, Neisseria meningitidis
atggaatttttcattatcttgctggcagccgtcgttgttttcggcttcaaatcctttgttgtcatcccacagcaggaagtccacgttgtcgaaaggctcgggcgtttccatcgcgccctgacggccggtttgaatattttgattccctttatcgaccgcgtcgcctaccgccattcgctgaaagaaatccctttagacgtacccagccaggtctgcatcacgcgcgacaatacgcagctgactgttgacggtatcatctatttccaagtaaccgaccccaaactcgcctcatacggttcgagcaactacattatggcgattacccagcttgcccaaacgacgctgcgttccgttatcgggcgtatggaattggacaaaacgtttgaagaacgcgacgaaatcaacagcaccgtcgtctccgccctcgatgaagccgccggagcttggggtgtgaaggttttgcgttatgagattaaagacttggttccgccgcaagaaatccttcgctcaatgcaggcgcaaattactgctgaacgcgaaaaacgcgcccgtatcgccgaatccgaaggtcgtaaaatcgaacaaatcaaccttgccagtggtcagcgcgaagccgaaatccaacaatccgaaggcgaggctcaggctgcggtcaatgcgtcaaatgccgagaaaatcgcccgcatcaaccgcgccaaaggtgaagcggaatccttgcgccttgttgccgaagccaatgccgaagccatccgtcaaattgccgccgcccttcaaacccaaggcggtgcggatgcggtcaatctgaagattgcggaacaatacgtcgccgcgttcaacaatcttgccaaagaaagcaatacgctgattatgcccgccaatgttgccgacatcggcagcctgatttctgccggtatgaaaattatcgacagcagcaaaaccgccaaataa

SEQ ID NO: 38738 - protein, 315 aa, Neisseria meningitidis
MEFFIILLAAVVVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 38739 - DNA, 948 bp, Neisseria meningitidis
atggaatttttcattatcttgttggtagccgtcgccgttttcggtttcaaatcctttgttgtcatcccacaacaggaagtccacgttgtcgaaaggctggggcgtttccatcgcgccctgacggccggtttgaatattttgattccctttatcgaccgcgtcgcctaccgccattcgctgaaagaaatccctttagacgtacccagccaggtctgcatcacgcgcgacaatacgcagctgactgttgacggcatcatctatttccaagtaaccgaccccaaactcgcctcatacggttcgagcaactacattatggcgattacccagcttgcccaaacgacgctgcgttccgttatcgggcgtatggagttggacaaaacgtttgaagaacgcgacgaaatcaacagtactgttgttgcggctttggacgaggcggccggggcttggggtgtgaaggttttgcgttatgagattaaagacttggttccgccgcaagaaatccttcgctcaatgcaggcgcaaattactgccgaacgcgaaaaacgcgcccgtatcgccgaatccgaaggtcgtaaaatcgaacaaatcaaccttgccagtggtcagcgcgaagccgaaatccaacaatccgaaggcgaggctcaggctgcggtcaatgcgtcaaatgccgagaaaatcgcccgcatcaaccgcgccaaaggtgaagcggaatccttgcgccttgttgccgaagccaatgccgaagccatccgtcaaattgccgccgcccttcaaacccaaggcggtgcggatgcggtcaatctgaagattgcggaacaatacgtcgctgcgttcaacaatcttgccaaagaaagcaatacgctgattatgcccgccaatgttgccgacatcggcagcctgatttctgccggtatgaaaattatcgacagcagcaaaaccgccaaataa

SEQ ID NO: 38740 - protein, 315 aa, Neisseria meningitidis
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 38741 - DNA, 948 bp, Neisseria gonorrhoeae
atggaatttttcattatcttgttggcagccgtcgccgttttcggcttcaaatcctttgtcgtcatcccccagcaggaagtccacgttgtcgaaaggctcgggcgtttccatcgcgccctgacggccggtttgaatattttgattccctttatcgaccgcgtcgcctaccgccattcgctgaaagaaatccctttagacgtacccagccaggtctgcatcacgcgcgataatacgcaattgactgttgacggcatcatctatttccaagtaaccgatcccaaactcgcctcatacggttcgagcaactacattatggcaattacccagcttgcccaaacgacgctgcgttccgttatcgggcgtatggagttggacaaaacgtttgaagaacgcgacgaaatcaacagtaccgtcgtctccgccctcgatgaagccgccggggcttggggtgtgaaagtcctccgttacgaaatcaaggatttggttccgccgcaagaaatccttcgcgcaatgcaggcacaaattaccgccgaacgcgaaaaacgcgcccgtattgccgaatccgaaggccgtaaaatcgaacaaatcaaccttgccagtggtcagcgtgaagccgaaatccaacaatccgaaggcgaggctcaggctgcggtcaatgcgtccaatgccgagaaaatcgcccgcatcaaccgcgccaaaggcgaagcggaatccctgcgccttgttgccgaagccaatgccgaagccatccgtcaaattgccgccgcccttcaaacccaaggcggggcggatgcggtcaatctgaagattgcggaacaatacgtagccgcgttcaacaatcttgccaaagaaagcaatacgctgattatgcccgccaatgttgccgacatcggcagcctgatttctgccggcatgaaaattatcgacagcagcaaaaccgccaaataa

SEQ ID NO: 38742 - protein, 315 aa, Neisseria gonorrhoeae
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRAMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 38743 - DNA, 948 bp, Neisseria meningitidis; identical to SEQ ID NO: 38737

SEQ ID NO: 38744 - protein, 315 aa, Neisseria meningitidis; identical to SEQ ID NO: 38738

SEQ ID NO: 38745 - DNA, 669 bp, Neisseria meningitidis
atgcagcaggcaagctatgcgatgggcgtggacatcggacgctccctgaagcaaatgaaggaacagggcgcggaaatcgatttgaaagtctttaccgaagccatgcaggcagtgtatgacggcaaagaaatcaaaatgaccgaagagcaggctcaggaagtcatgatgaaattccttcaggaacaacaggctaaagccgtagaaaaacacaaggcggacgcgaaggccaataaagaaaaaggcgaagcctttctgaaagaaaatgccgccaaagacggcgtgaagaccactgcttccggcctgcaatacaaaatcaccaaacagggcgaaggcaaacagccgaccaaagacgacatcgttaccgtggaatacgaaggccgcctgattgacggtacggtattcgacagcagcaaagccaacggcggcccggtcaccttccctttgagccaagtgattccgggttggaccgaaggcgtacagcttctgaaagaaggcggcgaagccacgttctacatcccgtccaaccttgcctaccgcgaacagggtgcgggcgacaaaatcggtccgaacgccactttggtatttgatgtgaaactggtcaaaatcggcgcacccgaaaacgcgcccgccaagcagccggctcaagtcgacatcaaaaaagtaaattaa

SEQ ID NO: 38746 - protein, 222 aa, Neisseria meningitidis
MQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPVTFPLSQVIPGWTEGVQLLKEGGEATFYIPSNLAYREQGAGDKIGPNATLVFDVKLVKIGAPENAPAKQPAQVDIKKVN

SEQ ID NO: 38747 - DNA, 648 bp, Neisseria gonorrhoeae
atgggcgtggacatcggacgctccctgaaacaaatgaaggaacagggcgcggaaatcgatttgaaagtctttaccgatgccatgcaggcagtgtatgacggcaaagaaatcaaaatgaccgaagagcaggcccaggaagtgatgatgaaattcctgcaggagcagcaggctaaagccgtagaaaaacacaaggcggatgcgaaggccaacaaagaaaaaggcgaagccttcctgaaggaaaatgccgccgaagacggcgtgaagaccactgcttccggtctgcagtacaaaatcaccaaacagggtgaaggcaaacagccgacaaaagacgacatcgttaccgtggaatacgaaggccgcctgattgacggtaccgtattcgacagcagcaaagccaacggcggcccggccaccttccctttgagccaagtgattccgggttggaccgaaggcgtacggcttctgaaagaaggcggcgaagccacgttctacatcccgtccaaccttgcctaccgcgaacagggtgcgggcgaaaaaatcggtccgaacgccactttggtatttgacgtgaaactggtcaaaatcggcgcacccgaaaacgcgcccgccaagcagccggatcaagtcgacatcaaaaaagtaaattaa

SEQ ID NO: 38748 - protein, 215 aa, Neisseria gonorrhoeae
MGVDIGRSLKQMKEQGAEIDLKVFTDAMQAVYDGKEIKMTEEQAQEVMMKFLQEQQAKAVEKHKADAKANKEKGEAFLKENAAEDGVKTTASGLQYKITKQGEGKQPTKDDIVTVEYEGRLIDGTVFDSSKANGGPATFPLSQVIPGWTEGVRLLKEGGEATFYIPSNLAYREQGAGEKIGPNATLVFDVKLVKIGAPENAPAKQPDQVDIKKVN

SEQ ID NO: 38749 - DNA, 819 bp, Neisseria meningitidis
atgaacaccattttcaaaatcagcgcactgaccctttccgccgctttggcactttccgcctgcggcaaaaaagaagccgcccccgcatctgcatccgaacctgccgccgcttcttccgcgcagggcgacacctcttcgatcggcagcacgatgcagcaggcaagctatgcgatgggcgtggacatcggacgctccctgaagcaaatgaaggaacagggcgcggaaatcgatttgaaagtctttaccgaagccatgcaggcagtgtatgacggcaaagaaatcaaaatgaccgaagagcaggctcaggaagtcatgatgaaattccttcaggaacaacaggctaaagccgtagaaaaacacaaggcggacgcgaaggccaataaagaaaaaggcgaagcctttctgaaagaaaatgccgccaaagacggcgtgaagaccactgcttccggcctgcaatacaaaatcaccaaacagggcgaaggcaaacagccgaccaaagacgacatcgttaccgtggaatacgaaggccgcctgattgacggtacggtattcgacagcagcaaagccaacggcggcccggtcaccttccctttgagccaagtgattctgggttggaccgaaggcgtacagcttctgaaagaaggcggcgaagccacgttctacatcccgtccaaccttgcctaccgcgaacagggtgcgggcgacaaaatcggcccgaacgccactttggtatttgatgtgaaactggtcaaaatcggcgcacccgaaaacgcgcccgccaagcagccggctcaagtcgacatcaaaaaagtaaattaa

SEQ ID NO: 38750 - protein, 272 aa, Neisseria meningitidis
MNTIFKISALTLSAALALSACGKKEAAPASASEPAAASSAQGDTSSIGSTMQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPVTFPLSQVILGWTEGVQLLKEGGEATFYIPSNLAYREQGAGDKIGPNATLVFDVKLVKIGAPENAPAKQPAQVDIKKVN

SEQ ID NO: 38751 - DNA, 819 bp, Neisseria meningitidis
atgaacaccattttcaaaatcagcgcactgaccctttccgccgctttggcactttccgcctgcggcaaaaaagaagccgcccccgcatctgcatccgaacctgccgccgcttcttccgcgcagggcgacacctcttcgatcggcagcacgatgcagcaggcaagctatgcgatgggcgtggacatcggacgctccctgaagcaaatgaaggaacagggcgcggaaatcgatttgaaagtctttaccgaagccatgcaggcagtgtatgacggcaaagaaatcaaaatgaccgaagagcaggctcaggaagtcatgatgaaattccttcaggaacaacaggctaaagccgtagaaaaacacaaggcggacgcgaaggccaataaagaaaaaggcgaagcctttctgaaagaaaatgccgccaaagacggcgtgaagaccactgcttccggcctgcaatacaaaatcaccaaacagggcgaaggcaaacagccgaccaaagacgacatcgttaccgtggaatacgaaggccgcctgattgacggtacggtattcgacagcagcaaagccaacggcggcccggtcaccttccctttgagccaagtgattccgggttggaccgaaggcgtacagcttctgaaagaaggcggcgaagccacgttctacatcccgtccaaccttgcctaccgcgaacagggtgcgggcgacaaaatcggtccgaacgccactttggtatttgatgtgaaactggtcaaaatcggcgcacccgaaaacgcgcccgccaagcagccggctcaagtcgacatcaaaaaagtaaattaa

SEQ ID NO: 38752 - protein, 272 aa, Neisseria meningitidis
MNTIFKISALTLSAALALSACGKKEAAPASASEPAAASSAQGDTSSIGSTMQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPVTFPLSQVIPGWTEGVQLLKEGGEATFYIPSNLAYREQGAGDKIGPNATLVFDVKLVKIGAPENAPAKQPAQVDIKKVN

SEQ ID NO: 38753 - DNA, 819 bp, Neisseria gonorrhoeae
atgaacaccattttcaaaatcagcgcactgaccctttccgccgctttggcactttccgcctgcggcaaaaaagaagccgcccccgcatctgcatccgaacctgccgccgcttctgccgcgcagggcgacacctcttcaatcggcagcacgatgcagcaggcaagctatgcaatgggcgtggacatcggacgctccctgaaacaaatgaaggaacagggcgcggaaatcgatttgaaagtctttaccgatgccatgcaggcagtgtatgacggcaaagaaatcaaaatgaccgaagagcaggcccaggaagtgatgatgaaattcctgcaggagcagcaggctaaagccgtagaaaaacacaaggcggatgcgaaggccaacaaagaaaaaggcgaagccttcctgaaggaaaatgccgccaaagacggcgtgaagaccactgcttccggtctgcagtacaaaatcaccaaacagggtgaaggcaaacagccgacaaaagacgacatcgttaccgtggaatacgaaggccgcctgattgacggtaccgtattcgacagcagcaaagccaacggcggcccggccaccttccctttgagccaagtgattccgggttggaccgaaggcgtacggcttctgaaagaaggcggcgaagccacgttctacatcccgtccaaccttgcctaccgcgaacagggtgcgggcgaaaaaatcggtccgaacgccactttggtatttgacgtgaaactggtcaaaatcggcgcacccgaaaacgcgcccgccaagcagccggatcaagtcgacatcaaaaaagtaaattaa

SEQ ID NO: 38754 - protein, 272 aa, Neisseria gonorrhoeae
MNTIFKISALTLSAALALSACGKKEAAPASASEPAAASAAQGDTSSIGSTMQQASYAMGVDIGRSLKQMKEQGAEIDLKVFTDAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPATFPLSQVIPGWTEGVRLLKEGGEATFYIPSNLAYREQGAGEKIGPNATLVFDVKLVKIGAPENAPAKQPDQVDIKKVN

SEQ ID NO: 38755 - DNA, 819 bp, Neisseria meningitidis; identical to SEQ ID NO: 38749

SEQ ID NO: 38756 - protein, 272 aa, Neisseria meningitidis; identical to SEQ ID NO: 38750

SEQ ID NO: 38757 - DNA, 1326 bp, Neisseria meningitidis
atgaaaaaatacctattccgcgccgccctgtacggcatcgccgccgccatcctcgccgcctgccaaagcaagagcatccaaacctttccgcaacccgacacatccgtcatcaacggcccggaccggccggtcggcatccccgaccccgccggaacgacggtcggcggcggcggggccgtctataccgttgtaccgcacctgtccctgccccactgggcggcgcaggatttcgccaaaagcctgcaatccttccgcctcggctgcgccaatttgaaaaaccgccaaggctggcaggatgtgtgcgcccaagcctttcaaacccccgtccattcctttcaggcaaaacagttttttgaacgctatttcacgccgtggcaggttgcaggcaacggaagccttgccggtacggttaccggctattacgaaccggtgctgaagggcgacgacaggcggacggcacaagcccgcttcccgatttacggtattcccgacgattttatctccgtccccctgcctgccggtttgcggagcggaaaagcccttgtccgcatcaggcagacgggaaaaaacagcggcacaatcgacaataccggcggcacacataccgccgacctctcccgattccccatcaccgcgcgcacaacagcaatcaaaggcaggtttgaaggaagccgcttcctcccctaccacacgcgcaaccaaatcaacggcggcgcgcttgacggcaaagccccgatactcggttacgccgaagaccctgtcgaacttttttttatgcacatccaaggctcgggccgtctgaaaaccccgtccggcaaatacatccgcatcggctatgccgacaaaaacgaacatccytacgtttccatcggacgctatatggcggataagggctacctcaaactcggacaaacctccatgcagggcattaagtcttatatgcggcaaaatccgcaacgcctcgccgaagttttgggtcaaaaccccagctatatctttttccgcgagcttgccggaagcagcaatgacggccctgtcggcgcactgggcacgccgctgatgggggaatatgccggcgcagtcgaccggcactacattaccttgggtgcgcccttatttgtcgccaccgcccatccggttacccgcaaagccctcaaccgcctgattatggcgcaggataccggcagcgcgattaaaggcgcggtgcgcgtggattatttttggggatacggcgacgaagccggcgaacttgccggcaaacagaaaaccacgggatatgtctggcagctcctacccaacggtatgaagcccgaataccgcccgtaa

SEQ ID NO: 38758 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 38759 - DNA, 1326 bp, Neisseria meningitidis
atgaaaaaatacctattccgcgccgccctgtacggcatcgccgccgccatcctcgccgcctgccaaagcaagagcatccaaacctttccgcaacccgacacatccgtcatcaacggcccggaccggccggtcggcatccccgaccccgccggaacgacggtcggcggcggcggggccgtctataccgttgtaccgcacctgtccctgccccactgggcggcgcaggatttcgccaaaagcctgcaatccttccgcctcggctgcgccaatttgaaaaaccgccaaggctggcaggatgtgtgcgcccaagcctttcaaacccccgtccattcctttcaggcaaaacagttttttgaacgctatttcacgccgtggcaggttgcaggcaacggaagccttgccggtacggttaccggctattacgaaccggtgctgaagggcgacgacaggcggacggcacaagcccgcttcccgatttacggtattcccgacgattttatctccgtccccctgcctgccggtttgcggagcggaaaagcccttgtccgcatcaggcagacgggaaaaaacagcggcacaatcgacaataccggcggcacacataccgccgacctctcccgattccccatcaccgcgcgcacaacagcaatcaaaggcaggtttgaaggaagccgcttcctcccctaccacacgcgcaaccaaatcaacggcggcgcgcttgacggcaaagccccgatactcggttacgccgaagaccctgtcgaacttttttttatgcacatccaaggctcgggccgtctgaaaaccccgtccggcaaatacatccgcatcggctatgccgacaaaaacgaacatccctacgtttccatcggacgctatatggcggataagggctacctcaaactcggacaaacctccatgcagggcattaagtcttatatgcggcaaaatccgcaacgcctcgccgaagttttgggtcaaaaccccagctatatctttttccgcgagcttgccggaagcagcaatgacggccctgtcggcgcactgggcacgccgctgatgggggaatatgccggcgcagtcgaccggcactacattaccttgggtgcgcccttatttgtcgccaccgcccatccggttacccgcaaagccctcaaccgcctgattatggcgcaggataccggcagcgcgattaaaggcgcggtgcgcgtggattatttttggggatacggcgacgaagccggcgaacttgccggcaaacagaaaaccacgggatatgtctggcagctcctacccaacggtatgaagcccgaataccgcccgtaa

SEQ ID NO: 38760 - protein, 441 aa, Neisseria meningitidis; identical to SEQ ID NO: 38758

SEQ ID NO: 38761 - DNA, 1326 bp, Neisseria gonorrhoeae
atgaaaaaacacctgctccgctccgccctgtacggcatcgccgccgccatcctcgccgcctgccaaagcaggagcatccaaacctttccgcaacccgacacatccgtcatcaacggcccggaccggccggccggcatccccgaccccgccggaacgacggttgccggcggcggggccgtctataccgttgtgccgcacctgtccatgccccactgggcggcgcaggattttgccaaaagcctgcaatccttccgcctcggctgcgccaatttgaaaaaccgccaaggctggcaggatgtgtgcgcccaagcctttcaaacccccgtgcattcctttcaggcaaagcggttttttgaacgctatttcacgccgtggcaggttgcaggcaacggaagccttgcaggtacggttaccggctattacgaaccggtgctgaagggcgacggcaggcggacggaacgggcccgcttcccgatttacggtattcccgacgattttatctccgtcccgctgcctgccggtttgcggggcggaaaaaaccttgtccgcatcaggcagacggggaaaaacagcggcacgatcgacaatgccggcggcacgcataccgccgacctctcccgattccccatcaccgcgcgcacaacggcaatcaaaggcaggtttgaaggaagccgcttcctcccttaccacacgcgcaaccaaatcaacggcggcgcgcttgacggcaaagcccccatcctcggttacgccgaagaccccgtcgaactttttttcatgcacatccaaggctcgggccgcctgaaaaccccgtccggcaaatacatccgcatcggatacgccgacaaaaacgaacatccgtatgtttccatcggacgctatatggcggacaaaggctacctcaagctcgggcagacctcgatgcagggcatcaaagcctatatgcggcaaaatccgcaacgcctcgccgaagttttgggtcaaaaccccagctatatctttttccgcgagcttgccggaagcggcaatgagggccccgtcggcgcactgggcacgccactgatgggggaatacgccggcgcaatcgaccggcactacattaccttgggcgcgcccttatttgtcgccaccgcccatccggttacccgcaaagccctcaaccgcctgattatggcgcaggatacaggcagcgcgatcaaaggcgcggtgcgcgtggattatttttggggttacggcgacgaagccggcgaacttgccggcaaacagaaaaccacgggatacgtctggcagctcctgcccaacggcatgaagcccgaataccgcccgtga

SEQ ID NO: 38762 - protein, 441 aa, Neisseria gonorrhoeae
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPVHSFQAKRFFERYFTPWQVAGNGSLAGTVTGYYEPVLKGDGRRTERARFPIYGIPDDFISVPLPAGLRGGKNLVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSGNEGPVGALGTPLMGEYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 38763 - DNA, 1326 bp, Neisseria meningitidis
atgaaaaaatacctattccgcgccgccctgtgcggcatcgccgccgccatcctcgccgcctgccaaagcaagagcatccaaacctttccgcaacccgacacatccgtcatcaacggcccggaccggccggtcggcatccccgaccccgccggaacgacggtcggcggcggcggggccgtttataccgttgtgccgcacctgtccctgccccactgggcggcgcaggatttcgccaaaagcctgcaatccttccgcctcggctgcgccaatttgaaaaaccgccaaggctggcaggatgtgtgcgcccaagcctttcaaacccccgtccattccgttcaggcaaaacagttttttgaacgctatttcacgccgtggcaggttgcaggcaacggaagccttgccggtacggttaccggctattacgagccggtgctgaagggcgacgacaggcggacggcacaagcccgcttcccgatttacggtattcccgacgattttatctccgtccccctgcctgccggtttgcggagcggaaaagcccttgtccgcatcaggcagacgggaaaaaacagcggcacaatcgacaataccggcggcacacataccgccgacctctcccaattccccatcactgcgcgcacaacggcaatcaaaggcaggtttgaaggaagccgcttcctcccctaccacacgcgcaaccaaatcaacggcggcgcgcttgacggcaaagccccgatactcggttacgccgaagaccccgtcgaacttttttttatgcacatccaaggctcgggccgtctgaaaaccccgtccggcaaatacatccgcatcggctatgccgacaaaaacgaacatccctacgtttccatcggacgctatatggcggacaaaggctacctcaagctcgggcagacctcgatgcagggcatcaaagcctatatgcagcaaaacccgcaacgcctcgccgaagttttggggcaaaaccccagctatatctttttccgagagcttaccggaagcagcaatgacggccctgtcggcgcactgggcacgccgctgatgggcgagtacgccggcgcagtcgaccggcactacattaccttgggcgcgcccttatttgtcgccaccgcccatccggttacccgcaaagccctcaaccgcctgattatggcgcaggataccggcagcgcgattaaaggcgcggtgcgcgtggattatttttggggatacggcgacgaagccggcgaacttgccggcaaacagaaaaccacgggatatgtctggcagcttctgcccaacggtatgaagcccgaataccgcccgtaa

SEQ ID NO: 38764 - protein, 441 aa, Neisseria meningitidis
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 38765 - DNA, 1101 bp, Neisseria meningitidis
  misc_feature (1)..(1101): N is any nucleotide
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcttccttacgacaaaaacggtgcaaagtcggcacaaggcaacatattgccgcaactgctcgacaggctgctcgcccacccgtatttcgcacaacgccaccctaaaagcacggggcgcgaactgtttgccataaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcgacggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 38766 - protein, 366 aa, Neisseria meningitidis
  misc_feature (1)..(366): Xaa is any amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAXXXXXXXXXXXXXXXXXXXXXXXXXXXXXXXXXXXXXXXXXXXXXXXXXXXXXXXXXXXXXXXXXXXXXXXXXXXXXXXXXQLPYDKNGAKSAQGNILPQLLDRLLAHPYFAQRHPKSTGRELFAINWLETYLDGGENRYDVLRTLSRFTAQTVCDAVSHAAADARQMYICDGGIRNPVLMADLAECFGTRVSLHSTADLNLDPQWVEAAXFAWLAACWINRIPGSPHKATGASKPCILXAGYYY

SEQ ID NO: 38767 - DNA, 1101 bp, Neisseria gonorrhoeae
atggaaacacagctttacatcggcattatgtcgggaaccagtatggacggggcggatgccgtgctggtacggatggacggcggcaaatggctgggcgcggaagggcacgcctttaccccctaccctgaccggttgcgccgcaaattgctggatttgcaggacacaggcacagacgaactgcaccgcagcaggatgttgtcgcaagaactcagccgcctgtacgcgcaaaccgccgccgaactgctgtgcagtcaaaacctcgctccgtgcgacattaccgccctcggctgccacgggcaaaccgtccgacacgcgccggaacacggttacagcatacagcttgccgatttgccgctgctggcggaactgacgcggatttttaccgtcggcgacttccgcagccgcgaccttgctgccggcggacaaggtgcgccgctcgtccccgcctttcacgaagccctgttccgcgatgacagggaaacacgcgtggtactgaacatcggcgggattgccaacatcagcgtactcccccccggcgcacccgccttcggcttcgacacagggccgggcaatatgctgatggacgcgtggacgcaggcacactggcagctgccttacgacaaaaacggtgcaaaggcggcacaaggcaacatattgccgcaactgctcggcaggctgctcgcccacccgtatttctcacaaccccacccaaaaagcacggggcgcgaactgtttgccctaaattggctcgaaacctaccttgacggcggcgaaaaccgatacgacgtattgcggacgctttcccgattcaccgcgcaaaccgtttgggacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatcctcaatgggtggaggcggccgcatttgcgtggttggcggcgtgttggattaaccgcattcccggtagtccgcacaaagcgaccggcgcatccaaaccgtgtattctgggcgcgggatattattattga

SEQ ID NO: 38768 - protein, 366 aa, Neisseria gonorrhoeae
METQLYIGIMSGTSMDGADAVLVRMDGGKWLGAEGHAFTPYPDRLRRKLLDLQDTGTDELHRSRMLSQELSRLYAQTAAELLCSQNLAPCDITALGCHGQTVRHAPEHGYSIQLADLPLLAELTRIFTVGDFRSRDLAAGGQGAPLVPAFHEALFRDDRETRVVLNIGGIANISVLPPGAPAFGFDTGPGNMLMDAWTQAHWQLPYDKNGAKAAQGNILPQLLGRLLAHPYFSQPHPKSTGRELFALNWLETYLDGGENRYDVLRTLSRFTAQTVWDAVSHAAADARQMYICGGGIRNPVLMADLAECFGTRVSLHSTAELNLDPQWVEAAAFAWLAACWINRIPGSPHKATGASKPCILGAGYYY

SEQ ID NO: 38769 - DNA, 1101 bp, Neisseria meningitidis
atggaaacacagctttacatcggcatcatgtcgggaaccagcatggacggggcggatgccgtactgatacggatggacggcggcaaatggctgggcgcggaagggcacgcctttaccccctaccccggcaggttacgccgcaaattgctggatttgcaggacacaggcgcggacgaactgcaccgcagcaggatgttgtcgcaagaactcagccgcctgtacgcgcaaaccgccgccgaactgctgtgcagtcaaaacctcgcgccgtccgacattaccgccctcggctgccacgggcaaaccgtcagacacgcgccggaacacagttacagcgtacagcttgccgatttgccgctgctggcggaacggactcagatttttaccgtcggcgacttccgcagccgcgaccttgcggccggcggacaaggcgcgccgctcgtccccgcctttcacgaagccctgttccgcgacgacagggaaacacgcgcggtactgaacatcggcgggattgccaacatcagcgtactcccccccgacgcacccgccttcggcttcgacacaggaccgggcaatatgctgatggacgcgtggatgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgattcaccgcgcaaaccgttttcgacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatccgcaatgggtagaagccgccgcgttcgcatggatggcggcgtgttgggtcaaccgcattcccggtagtccgcacaaagcaaccggcgcatccaaaccgtgtattctgggcgcgggatattattattga

SEQ ID NO: 38770 - protein, 366 aa, Neisseria meningitidis
METQLYIGIMSGTSMDGADAVLIRMDGGKWLGAEGHAFTPYPGRLRRKLLDLQDTGADELHRSRMLSQELSRLYAQTAAELLCSQNLAPSDITALGCHGQTVRHAPEHSYSVQLADLPLLAERTQIFTVGDFRSRDLAAGGQGAPLVPAFHEALFRDDRETRAVLNIGGIANISVLPPDAPAFGFDTGPGNMLMDAWMQAHWQLPYDKNGAKAAQGNILPQLLDRLLAHPYFAQPHPKSTGRELFALNWLETYLDGGENRYDVLRTLSRFTAQTVFDAVSHAAADARQMYICGGGIRNPVLMADLAECFGTRVSLHSTAELNLDPQWVEAAAFAWMAACWVNRIPGSPHKATGASKPCILGAGYYY

SEQ ID NO: 38771 - DNA, 1101 bp, Neisseria meningitidis
  misc_feature (995)..(995): N is any nucleotide
  misc_feature (1082)..(1082): N is any nucleotide
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcggaacggacgcggatttttaccgtcggcgacttccgcagccgcgaccttgcggccggcggacaaggcgcgccactcgtccccgcctttcacgaagccctgttccgcgacaacagggaaacacgcgcggtactgaacatcggcgggattgccaacatcagcgtactcccccccgacgcacccgccttcggcttcgacacagggccgggcaatatgctgatggacgcgtggacgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcggcggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 38772 - protein, 366 aa, Neisseria meningitidis
  misc_feature (332)..(332): Xaa is any amino acid
  misc_feature (361)..(361): Xaa is any amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAERTRIFTVGDFRSRDLAAGGQGAPLVPAFHEALFRDNRETRAVLNIGGIANISVLPPDAPAFGFDTGPGNMLMDAWTQAHWQLPYDKNGAKAAQGNILPQLLDRLLAHPYFAQPHPKSTGRELFALNWLETYLDGGENRYDVLRTLSRFTAQTVCDAVSHAAADARQMYICGGGIRNPVLMADLAECFGTRVSLHSTADLNLDPQWVEAAXFAWLAACWINRIPGSPHKATGASKPCILXAGYYY

SEQ ID NO: 38773 - DNA, 1101 bp, Neisseria meningitidis; identical to SEQ ID NO: 38769

SEQ ID NO: 38774 - protein, 366 aa, Neisseria meningitidis; identical to SEQ ID NO: 38770

SEQ ID NO: 38775 - DNA, 396 bp, Neisseria meningitidis
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactgcgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccac

SEQ ID NO: 38776 - protein, 132 aa, Neisseria meningitidis
MTDNALLHLGEEPRFDQIKTEDIKPALQTAIAEAREQIAAIKAQTHTGWANTVEPLTGITERVGRIWGVVSHLNCVADTPELRAVYNELMPEITVFFTEIGQDIELYNRFKTIKNSPEFDTLSPAQKTKLNH

SEQ ID NO: 38777 - DNA, 2037 bp, Neisseria gonorrhoeae
atgattgacaacgcactgctccacttgggcgaagaaccccgttttaatcaaatccaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtagaatgggacgcggtcgaactgcccagccagtttatggaaaacttcgtttgggaatacaatgtattggcacaaatgtccgcccacgaagaaaccggcgagcccctgccgaaagaactcttcgacaaaatgctcgccgccaaaaacttccagcgcggtatgttcctcgtccggcaaatggagttcgccctcttcgatatgatgatttacagtgaaagcgacgaatgccgtctgaaaaactggcagcaggttttagacagcgtgcgcaaagaagtcgccgtcatccaaccgcccgaatacaaccgcttcgccaacagcttcggccacatcttcgccggcggctattccgcaggctattacagctacgcatgggccgaagtcctcagcaccgatgcctacgccgcctttgaagaaagcgacgacgtcgccgccacaggcaaacgcttctggcaagaaatccttgccgtcggcggctcccgcagcgcggcggaatccttcaaagccttccgcggacgcgaaccgagcatagacgcactgctgcgccaaagcggtttcgacaacgcggcttga

SEQ ID NO: 38778 - protein, 678 aa, Neisseria gonorrhoeae
MIDNALLHLGEEPRFNQIQTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVEWDAVELPSQFMENFVWEYNVLAQMSAHEETGEPLPKELFDKMLAAKNFQRGMFLVRQMEFALFDMMIYSESDECRLKNWQQVLDSVRKEVAVIQPPEYNRFANSFGHIFAGGYSAGYYSYAWAEVLSTDAYAAFEESDDVAATGKRFWQEILAVGGSRSAAESFKAFRGREPSIDALLRQSGFDNAA

SEQ ID NO: 38779 - DNA, 2037 bp, Neisseria meningitidis
atgactgacaacgcactgctccatttgggcgaagaaccccgttttgatcaaatcaaaaccgaagacatcaaacccgccctgcaaaccgccattgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcaccgacacgcccgaactgcgcgccgcctacaatgaattaatgcccgaaattaccgtcttcttcaccgaaatcggacaagacatcgagctgtacaaccgcttcaaaaccatcaaaaactcccccgagttcgacaccctctcccacgcgcaaaaaaccaaactcaaccacgatctgcgcgatttcgtcctcagcggcgcggaactgccgcccgaacagcaggcagaattggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgctgccgcgcaaagcgaaggcaaaacaggctacaaaatcggtttgcagattccgcactacctcgccgtcatccaatacgccgacaaccgcaaactgcgcgaacaaatctaccgcgcctacgttacccgcgccagcgagctttcagacgacggcaaattcgacaacaccgccaacatcgaccgcacgctcgaaaacgccctgcaaaccgccaaactgctcggcttcaaaaactacgccgaattgtcgctggcaaccaaaatggcggacacccccgaacaagttttaaacttcctgcacgacctcgcccgccgcgccaaaccctacgccgaaaaagacctcgccgaagtcaaagccttcgcccgcgaaagcctcggcctcgccgatttgcaaccgtgggacttgggctacgccggcgaaaaactgcgcgaagccaaatacgcattcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcaccccgcccgtcggcggcaaagaagcccgcttgagccatgacgaaatcctcaccctcttccacgaaaccggacacggcctgcaccacctgcttacccaagtcgacgaactgggcgtatccggcatcaacggcgtagaatgggacgcagtcgaactgcccagtcagtttatggaaaatttcgtttgggaatacaatgtcttggcgcaaatgtccgcccacgaagaaaccggcgttcccctgccgaaagaactcttcgacaaaatgctcgccgccaaaaacttccaacgcggaatgttcctcgtccgccaaatggagttcgccctctttgatatgatgatttacagcgaagacgacgaaggccgtctgaaaaactggcaacaggttttagacagcgtgcgcaaagaagtcgccgtcgtccgaccgcccgaatacaaccgcttcgccaacagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggacgcgaaccgagcatagacgcactcttgcgccacagcggcttcgacaacgcggcttga

SEQ ID NO: 38780 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVTDTPELRAAYNELMPEITVFFTEIGQDIELYNRFKTIKNSPEFDTLSHAQKTKLNHDLRDFVLSGAELPPEQQAELAKLQTEGAQLSAKFSQNVLDATDAFGIYFDDAAPLAGIPEDALAMFAAAAQSEGKTGYKIGLQIPHYLAVIQYADNRKLREQIYRAYVTRASELSDDGKFDNTANIDRTLENALQTAKLLGFKNYAELSLATKMADTPEQVLNFLHDLARRAKPYAEKDLAEVKAFARESLGLADLQPWDLGYAGEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFTPPVGGKEARLSHDEILTLFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKEVAVVRPPEYNRFANSFGHIFAGGYSAGYYSYAWAEVLSADAYAAFEESDDVAATGKRFWQEILAVGGSRSAAESFKAFRGREPSIDALLRHSGFDNAA

SEQ ID NO: 38781 - DNA, 2037 bp, Neisseria meningitidis
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccacgatctgcgcgatttcgtcctcagcggcgcggaactgccgcccgaacagcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaagcaaaacaggctacaaaatcggcttgcagattccacactacctcgccgtcatccaatacgccgacaaccgcgaactgcgcgaacaaatctaccgcgcctacgttacccgcgccagcgaactttcagacgacggcaaattcgacaacaccgccaacatcgaccgcacgctcgcaaacgccctgcaaaccgccaaactgctcggcttcaaaaactacgccgaattgtcgctggcaaccaaaatggcggacacgcccgaacaagttttaaacttcctgcacgacctcgcccgccgcgccaaaccctacgccgaaaaagacctcgccgaagtcaaagccttcgcccgcgaaagcctgaacctcgccgatttgcaaccgtgggacttgggctacgccagcgaaaaactgcgcgaagccaaatacgcgttcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcgccccacccgtcggcggcagggaagcccgcctgagccacgacgaaatcctcatcctcttccacgaaaccggacacgggctgcaccacctgcttacccaagtggacgaactgggcgtatccggcatcaacggcgtagaatgggacgcggtcgaactgcccagccagtttatggaaaatttcgtttgggaatacaatgtcttggcacaaatgtcagcccacgaagaaaccggcgttcccctgccgaaagaactcttcgacaaaatgctcgccgccaaaaacttccaacgcggcatgttcctcgtccggcaaatggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggccgcgaaccgagcatagacgcactcttgcgccacagcggtttcgacaacgcggtctga

SEQ ID NO: 38782 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVADTPELRAVYNELMPEITVFFTEIGQDIELYNRFKTIKNSPEFDTLSPAQKTKLNHDLRDFVLSGAELPPEQQAELAKLQTEGAQLSAKFSQNVLDATDAFGIYFDDAAPLAGIPEDALAMFAAAAQSESKTGYKIGLQIPHYLAVIQYADNRELREQIYRAYVTRASELSDDGKFDNTANIDRTLANALQTAKLLGFKNYAELSLATKMADTPEQVLNFLHDLARRAKPYAEKDLAEVKAFARESLNLADLQPWDLGYASEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFAPPVGGREARLSHDEILILFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKKVAVIQPPEYNRFALSFGHIFAGGYSAGYYSYAWAEVLSADAYAAFEESDDVAATGKRFWQEILAVGGSRSAAESFKAFRGREPSIDALLRHSGFDNAV

SEQ ID NO: 38783 - DNA, 1473 bp, Neisseria gonorrhoeae
atgattgacaacgcactgctccacttgggcgaagaaccccgttttaatcaaatcaaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtaaaa

SEQ ID NO: 38784 - protein, 491 aa, Neisseria gonorrhoeae
MIDNALLHLGEEPRFNQIKTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVK

SEQ ID NO: 38785 - DNA, 2037 bp, Neisseria meningitidis; identical to SEQ ID NO: 38779

SEQ ID NO: 38786 - protein, 678 aa, Neisseria meningitidis; identical to SEQ ID NO: 38780

SEQ ID NO: 38787 - DNA, 534 bp, Neisseria meningitidis
atgtttccccccgacaaaacccttttcctctgtctcagcgcactgctcctcgcctcatgcggcacgacctccggcaaacaccgccaaccgaaacccaaacagacagtccggcaaatccaagccgtccgcatcagccacatcgaccgcacacaaggctcgcaggaactcatgctccacagcctcggactcatcggcacgccctacaaatggggcggcagcagcaccgcaaccggcttcgattgcagcggcatgattcaattcgtttacaaraacgccctcaacgtcaagctgccgcgcaccgcccgcgacatggcggcggcaagccgsaaaatccccgacagccgcytcaaggccggcgacctcgtattcttcaacaccggcggcgcacaccgctactcacacgtcggactctacatcggcaacggcgaattcatccatgcccccagcagcggcaaaaccatcaaaaccgaaaaactctccacaccgttttacgccaaaaactacctcggcgcacatactttttttacagaatga

SEQ ID NO: 38788 - protein, 177 aa, Neisseria meningitidis
  misc_feature (116)..(116): Xaa is any amino acid
MFPPDKTLFLCLSALLLASCGTTSGKHRQPKPKQTVRQIQAVRISHIDRTQGSQELMLHSLGLIGTPYKWGGSSTATGFDCSGMIQFVYKNALNVKLPRTARDMAAASRKIPDSRXKAGDLVFFNTGGAHRYSHVGLYIGNGEFIHAPSSGKTIKTEKLSTPFYAKNYLGAHTFFTE

SEQ ID NO: 38789 - DNA, 534 bp, Neisseria gonorrhoeae
atgttttcccccgacaaaacccttttcctctgtctcggcgcactgctcctcgcctcatgcggcacgacctccggcaaacaccgccaaccgaaacccaaacagacagtccggcaaatccaagccgtccgcatcagccacatcggccgcacacaaggctcgcaggaactcatgctccacagcctcggactcatcggcacgccctacaaatggggcggcagcagcaccgcaaccggcttcgactgcagcggcatgattcaattggtttacaaaaacgccctcaacgtcaagctgccgcgcaccgcccgcgacatggcggcggcaagccgcaaaatccccgacagccgcctcaaggccggcgacatcgtattcttcaacaccggcggcgcacaccgctactcacacgtcggactctacatcggcaacggcgaattcatccatgcccccggcagcggcaaaaccatcaaaaccgaaaaactctccacaccgttttacgccaaaaactaccttggagcgcatacgttttttacagaatga

SEQ ID NO: 38790 - protein, 177 aa, Neisseria gonorrhoeae
MFSPDKTLFLCLGALLLASCGTTSGKHRQPKPKQTVRQIQAVRISHIGRTQGSQELMLHSLGLIGTPYKWGGSSTATGFDCSGMIQLVYKNALNVKLPRTARDMAAASRKIPDSRLKAGDIVFFNTGGAHRYSHVGLYIGNGEFIHAPGSGKTIKTEKLSTPFYAKNYLGAHTFFTE

SEQ ID NO: 38791 - DNA, 534 bp, Neisseria meningitidis
atgtttccccccgacaaaacccttttcctctgtctcagcgcactgctcctcgcctcatgcggcacgacctccggcaaacaccgccaaccgaaacccaaacagacagtccggcaaatccaagccgtccgcatcagccacatcgaccgcacacaaggctcgcaggaactcatgctccacagcctcggactcatcggcacgccctacaaatggggcggcagcagcaccgcaaccggcttcgattgcagcggcatgattcaattcgtttacaaaaacgccctcaacgtcaagctgccgcgcaccgcccgcgacatggcggcggcaagccgcaaaatccccgacagccgccttaaggccggcgacctcgtattcttcaacaccggcggcgcacaccgctactcacacgtcggactctatatcggcaacggcgaattcatccatgcccccagcagcggcaaaaccatcaaaaccgaaaaactctccacaccgttttacgccaaaaactacctcggcgcacatactttctttacagaatga

SEQ ID NO: 38792 - protein, 177 aa, Neisseria meningitidis
MFPPDKTLFLCLSALLLASCGTTSGKHRQPKPKQTVRQIQAVRISHIDRTQGSQELMLHSLGLIGTPYKWGGSSTATGFDCSGMIQFVYKNALNVKLPRTARDMAAASRKIPDSRLKAGDLVFFNTGGAHRYSHVGLYIGNGEFIHAPSSGKTIKTEKLSTPFYAKNYLGAHTFFTE

SEQ ID NO: 38793 - DNA, 1467 bp, Neisseria meningitidis
atgtttaaacgcagcgtaatcgcaatggcttgtatttttgccctttcagcctgcgggggcggcggtggcggatcgcccgatgtcaagtcggcggacacgctgtcaaaacctgccgcccctgttgtttctgaaaaagagacagaggcaaaggaagatgcgccacaggcaggttctcaaggacagggcgcgccatccgcacaaggcagtcaagatatggcggcggtttcggaagaaaatacaggcaatggcggtgcggtaacagcggataatcccaaaaatgaagacgaggtggcacaaaatgatatgccgcaaaatgccgccggtacagatagttcgacaccgaatcacaccccggatccgaatatgcttgccggaaatatggaaaatcaagcaacggatgccggggaatcgtctcagccggcaaaccaaccggatatggcaaatgcggcggacggaatgcagggggacgatccgtcggcaggcgggcaaaatgccggcaatacggctgcccaaggtgcaaatcaagccggaaacaatcaagccgccggttcttcagatcccatccccgcgtcaaaccctgcacctgcgaatggcggtagcaattttggaagggttgatttggctaatggcgttttgattgacgggccgtcgcaaaatataacgttgacccactgtaaaggcgattcttgtagtggcaataatttcttggatgaagaagtacagctaaaatcagaatttgaaaaattaagtgatgcagacaaaataagtaattacaagaaagatgggaagaatgataaatttgtcggtttggttgccgatagtgtgcagatgaagggaatcaatcaatatattatcttttataaacctaaacccacttcatttgcgcgatttaggcgttctgcacggtcgaggcggtcgcttccggccgagatgccgctgattcccgtcaatcaggcggatacgctgattgtcgatggggaagcggtcagcctgacggggcattccggcaatatcttcgcgcccgaagggaattaccggtatctgacttacggggcggaaaaattgcccggcggatcgtatgcccttcgtgttcaaggcgaaccggcaaaaggcgaaatgcttgcgggcgcggccgtgtacaacggcgaagtactgcatttccatacggaaaacggccgtccgtacccgaccaggggcaggtttgccgcaaaagtcgatttcggcagcaaatctgtggacggcattatcgacagcggcgatgatttgcatatgggtacgcaaaaattcaaagccgccatcgatggaaacggctttaaggggacttggacggaaaatggcagcggggatgtttccggaaagttttacggcccggccggcgaggaagtggcgggaaaatacagctatcgcccgacagatgcggaaaagggcggattcggcgtgtttgccggcaaaaaagagcaggattga

SEQ ID NO: 38794 - protein, 488 aa, Neisseria meningitidis
MFKRSVIAMACIFALSACGGGGGGSPDVKSADTLSKPAAPVVSEKETEAKEDAPQAGSQGQGAPSAQGSQDMAAVSEENTGNGGAVTADNPKNEDEVAQNDMPQNAAGTDSSTPNHTPDPNMLAGNMENQATDAGESSQPANQPDMANAADGMQGDDPSAGGQNAGNTAAQGANQAGNNQAAGSSDPIPASNPAPANGGSNFGRVDLANGVLIDGPSQNITLTHCKGDSCSGNNFLDEEVQLKSEFEKLSDADKISNYKKDGKNDKFVGLVADSVQMKGINQYIIFYKPKPTSFARFRRSARSRRSLPAEMPLIPVNQADTLIVDGEAVSLTGHSGNIFAPEGNYRYLTYGAEKLPGGSYALRVQGEPAKGEMLAGAAVYNGEVLHFHTENGRPYPTRGRFAAKVDFGSKSVDGIIDSGDDLHMGTQKFKAAIDGNGFKGTWTENGSGDVSGKFYGPAGEEVAGKYSYRPTDAEKGGFGVFAGKKEQD

SEQ ID NO: 38795 - DNA, 1290 bp, Neisseria gonorrhoeae;
atgtttaaacgcagtgtgattgcaatggcttgtatttttcccctttcagcctgtgggggcggcggtggcggatcgcccgatgtcaagtcggcggacacgccgtcaaaaccggccgcccccgttgttgctgaaaatgccggggaaggggtgctgccgaaagaaaagaaagatgaggaggcagcgggcggtgcgccgcaagccgatacgcaggacgcaaccgccggagaaggcagccaagatatggcggcagtttcggcagaaaatacaggcaatggcggtgcggcaacaacggacaaccccaaaaatgaagacgcgggggcgcaaaatgatatgccgcaaaatgccgccgaatccgcaaatcaaacagggaacaaccaacccgccggttcttcagattccgcccccgcgtcaaaccctgcccctgcgaatggcggtagcgattttggaaggacgaacgtgggcaattctgttgtgattgacggaccgtcgcaaaatataacgttgacccactgtaaaggcgattcttgtaatggtgataatttattggatgaagaagcaccgtcaaaatcagaatttgaaaaattaagtgatgaagaaaaaattaagcgatataaaaaagacgagcaacgggagaattttgtcggtttggttgctgacagggtaaaaaaggatggaactaacaaatatatcatcttctatacggacaaaccacctactcgttctgcacggtcgaggaggtcgcttccggccgagattccgctgattcccgtcaatcaggccgatacgctgattgtggatggggaagcggtcagcctgacggggcattccggcaatatcttcgcgcccgaagggaattaccggtatctgacttacggggcggaaaaattgcccggcggatcgtatgccctccgtgtgcaaggcgaaccggcaaaaggcgaaatgcttgttggcacggccgtgtacaacggcgaagtgctgcatttccatatggaaaacggccgtccgtacccgtccggaggcaggtttgccgcaaaagtcgatttcggcagcaaatctgtggacggcattatcgacagcggcgatgatttgcatatgggtacgcaaaaattcaaagccgccatcgatggaaacggctttaaggggacttggacggaaaatggcggcggggatgtttccggaaggttttacggcccggccggcgaggaagtggcgggaaaatacagctatcgcccgacagatgctgaaaagggcggattcggcgtgtttgccggcaaaaaagatcgggattga

SEQ ID NO: 38796 - protein, 429 aa, Neisseria gonorrhoeae
MFKRSVIAMACIFPLSACGGGGGGSPDVKSADTPSKPAAPVVAENAGEGVLPKEKKDEEAAGGAPQADTQDATAGEGSQDMAAVSAENTGNGGAATTDNPKNEDAGAQNDMPQNAAESANQTGNNQPAGSSDSAPASNPAPANGGSDFGRTNVGNSVVIDGPSQNITLTHCKGDSCNGDNLLDEEAPSKSEFEKLSDEEKIKRYKKDEQRENFVGLVADRVKKDGTNKYIIFYTDKPPTRSARSRRSLPAEIPLIPVNQADTLIVDGEAVSLTGHSGNIFAPEGNYRYLTYGAEKLPGGSYALRVQGEPAKGEMLVGTAVYNGEVLHFHMENGRPYPSGGRFAAKVDFGSKSVDGIIDSGDDLHMGTQKFKAAIDGNGFKGTWTENGGGDVSGRFYGPAGEEVAGKYSYRPTDAEKGGFGVFAGKKDRD

SEQ ID NO: 38797 - DNA, 1494 bp, Neisseria meningitidis
atgtttaaacgcagtgtgattgcaatggcttgtattgttgccctttcagcctgtgggggcggcggtggcggatcgcccgatgttaagtcggcggacacgctgtcaaaacctgccgcccctgttgttactgaagatgtcggggaagaggtgctgccgaaagaaaagaaagatgaggaggcggtgagtggtgcgccgcaagccgatacgcaggacgcaaccgccggaaaaggcggtcaagatatggcggcagtttcggcagaaaatacaggcaatggcggtgcggcaacaacggataatcccgaaaataaagacgagggaccgcaaaatgatatgccgcaaaatgccgccgatacagatagttcgacaccgaatcacacccctgcaccgaatatgccaaccagagatatgggaaaccaagcaccggatgccggggaatcggcacaaccggcaaaccaaccggatatggcaaatgcggcggacggaatgcagggggacgatccgtcggcaggggaaaatgccggcaatacggcagatcaagctgcaaatcaagctgaaaacaatcaagtcggcggctctcaaaatcctgcctcttcaaccaatcctaacgccacgaatggcggcagcgattttggaaggataaatgtagctaatggcatcaagcttgacagcggttcggaaaatgtaacgttgacacattgtaaagacaaagtatgcgatagagatttcttagatgaagaagcaccaccaaaatcagaatttgaaaaattaagtgatgaagaaaaaattaataaatataaaaaagacgagcaacgagagaattttgtcggtttggttgctgacagggtagaaaagaatggaactaacaaatatgtcatcatttataaagacaagtccgcttcatcttcatctgcgcgattcaggcgttctgcacggtcgaggcggtcgcttccggccgagatgccgctgattcccgtcaatcaggcggatacgctgattgtcgatggggaagcggtcagcctgacggggcattccggcaatatcttcgcgcccgaagggaattaccggtatctgacttacggggcggaaaaattgtccggcggatcgtatgccctcagtgtgcaaggcgaaccggcaaaaggcgaaatgcttgcgggcacggccgtgtacaacggcgaagtgctgcatttccatatggaaaacggccgtccgtccccgtccggaggcaggtttgccgcaaaagtcgatttcggcagcaaatctgtggacggcattatcgacagcggcgatgatttgcatatgggtacgcaaaaattcaaagccgttatcgatggaaacggctttaaggggacttggacggaaaatggcggcggggatgtttccggaaggttttacggcccggccggcgaagaagtggcgggaaaatacagctatcgcccgacagatgcggaaaagggcggattcggcgtgtttgccggcaaaaaagagcaggattga

SEQ ID NO: 38798 - protein, 497 aa, Neisseria meningitidis
MFKRSVIAMACIVALSACGGGGGGSPDVKSADTLSKPAAPVVTEDVGEEVLPKEKKDEEAVSGAPQADTQDATAGKGGQDMAAVSAENTGNGGAATTDNPENKDEGPQNDMPQNAADTDSSTPNHTPAPNMPTRDMGNQAPDAGESAQPANQPDMANAADGMQGDDPSAGENAGNTADQAANQAENNQVGGSQNPASSTNPNATNGGSDFGRINVANGIKLDSGSENVTLTHCKDKVCDRDFLDEEAPPKSEFEKLSDEEKINKYKKDEQRENFVGLVADRVEKNGTNKYVIIYKDKSASSSSARFRRSARSRRSLPAEMPLIPVNQADTLIVDGEAVSLTGHSGNIFAPEGNYRYLTYGAEKLSGGSYALSVQGEPAKGEMLAGTAVYNGEVLHFHMENGRPSPSGGRFAAKVDFGSKSVDGIIDSGDDLHMGTQKFKAVIDGNGFKGTWTENGGGDVSGRFYGPAGEEVAGKYSYRPTDAEKGGFGVFAGKKEQD

SEQ ID NO: 38799 - DNA, 963 bp, Neisseria meningitidis
atgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgccactatgggcgaccaaggttcaggcagtttgacagggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctctcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatggggccgtataaagtaagcaaaggaattaaaccgacggaaggattaatggtcgatttctccgatatccgaccatacggcaatcatacgggtaactccgccccatccgtagaggctgataacagtcatgaggggtatggatacagcgatgaagtagtgcgacaacatagacaaggacaaccttga

SEQ ID NO: 38800 - protein, 320 aa, Neisseria meningitidis
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIRPYGNHTGNSAPSVEADNSHEGYGYSDEVVRQHRQGQP

SEQ ID NO: 38801 - DNA, 963 bp, Neisseria gonorrhoeae
atgcgggcacggctgctgatacctattcttttttcagtttttattttatccgcctgcgggacactgacaggtattccatcgcatggcggaggcaaacgcttcgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgcggcgaatacataaacagccctgccgtccgcaccgattacacctatccgcgttacgaaaccaccgctgaaacaacatcaggcggtttgacgggtttaaccacttctttatctacacttaatgcccctgcactctcgcgcacccaatcagacggtagcggaagtaggagcagtctgggcttaaatattggcgggatgggggattatcgaaatgaaaccttgacgaccaacccgcgcgacactgcctttctttcccacttggtgcagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaacccaaaaccaatgcgtttgaagctgcctataaagaaaattacgcattgtggatggggccgtataaagtaagcaaaggaatcaaaccgacggaaggattgatggtcgatttctccgatatccaaccatacggcaatcatacgggtaactccgccccatccgtagaggctgataacagtcatgaggggtatggatacagcgatgaagcagtgcgacaacatagacaagggcaaccttga

SEQ ID NO: 38802 - protein, 320 aa, Neisseria gonorrhoeae
MRARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSRSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHTGNSAPSVEADNSHEGYGYSDEAVRQHRQGQP

SEQ ID NO: 38803 - DNA, 963 bp, Neisseria meningitidis
atgcaagcacggctgctgatacctattcttttttcagtttttattttatccgcctgcgggacactgacaggtattccatcgcatggcggaggtaaacgcttcgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctcgcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacggatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatgggaccgtataaagtaagcaaaggaattaaaccgacagaaggattaatggtcgatttctccgatatccaaccatacggcaatcatatgggtaactctgccccatccgtagaggctgataacagtcatgaggggtatggatacagcgatgaagcagtgcgacgacatagacaagggcaaccttga

SEQ ID NO: 38804 - protein, 320 aa, Neisseria meningitidis
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHMGNSAPSVEADNSHEGYGYSDEAVRRHRQGQP

SEQ ID NO: 38805 - DNA, 606 bp, Neisseria meningitidis
atgaccatctatttcaaaaacggcttttacgacgacacattgggcggcatccccgaaggcgcggttgccgtccgcgccgaagaatacgccgcccttttggcaggacaggcgcagggcgggcagattgccgcagattccgacggccgccccgttttaaccccgccgcgcccgtccgattaccacgaatgggacggcaaaaaatggaaaatcagcaaagccgccgccgccgcccgtttcgccaaacaaaaaaccgccttggcattccgcctcgcggaaaaggcggacgaactcaaaaacagcctcttggcgggctatccccaagtggaaatcgacagcttttacaggcaggaaaaagaagccctcgcgcggcaggcggacaacaacgccccgaccccgatgctggcgcaaatcgccgccgcaaggggcgtggaattggacgttttgattgaaaaagttatcgaaaaatccgcccgcctggctgttgccgccggcgcgattatcggaaagcgtcagcagctcgaagacaaattgaacaccatcgaaaccgcgcccggattggacgcgctggaaaaggaaatcgaagaatggacgctaaacatcggctga

SEQ ID NO: 38806 - protein, 201 aa, Neisseria meningitidis
MTIYFKNGFYDDTLGGIPEGAVAVRAEEYAALLAGQAQGGQIAADSDGRPVLTPPRPSDYHEWDGKKWKISKAAAAARFAKQKTALAFRLAEKADELKNSLLAGYPQVEIDSFYRQEKEALARQADNNAPTPMLAQIAAARGVELDVLIEKVIEKSARLAVAAGAIIGKRQQLEDKLNTIETAPGLDALEKEIEEWTLNIG

SEQ ID NO: 38807 - DNA, 624 bp, Neisseria meningitidis
atgagaaaaccgaccgataccctacccgttaatctgcaacgccgccgcctgttgtgtgccgccggtgcgttgttgctcagtcctctggcgcacgccggcgcgcaacgtgaggaaacgcttgccgacgatgtggcttccgtgatgaggagttctgtcggcagcgtcaatccgccgaggctggtgtttgacaatccgaaagagggcgagcgttggttgtctgccatgtcggcacgtttggcaaggttcgtccccgaggaggaggagcggcgcaggctgctggtcaatatccagtacgaaagcagccgggccggtttggatacgcagattgtgttggggctgattgaggtggaaagcgcgttccgccagtatgcaatcagcggtgtcggcgcgcgcggcctgatgcaggttatgccgttttggaaaaactacatcggcaaaccggcgcacaacctgttcgacatccgcaccaacctgcgttacggctgtaccatcctgcgccattaccggaatcttgaaaaaggcaacatcgtccgcgcgcttgcccgctttaacggcagcttgggcagcaataaatatccgaacgccgttttgggcgcgtggcgcaaccgctggcagtggcgttga

SEQ ID NO: 38808 - protein, 207 aa, Neisseria meningitidis
MRKPTDTLPVNLQRRRLLCAAGALLLSPLAHAGAQREETLADDVASVMRSSVGSVNPPRLVFDNPKEGERWLSAMSARLARFVPEEEERRRLLVNIQYESSRAGLDTQIVLGLIEVESAFRQYAISGVGARGLMQVMPFWKNYIGKPAHNLFDIRTNLRYGCTILRHYRNLEKGNIVRALARFNGSLGSNKYPNAVLGAWRNRWQWR

SEQ ID NO: 38809 - DNA, 564 bp, Neisseria meningitidis
atgaaaaaaatcatcttcgccgcactcgcagccgccgccatcagtactgcctccgccgccacctacaaagtggacgaatatcacgccaacgcccgtttcgccatcgaccatttcaacaccagcaccaacgtcggcggtttttacggtctgaccggttccgtcgagttcgaccaagcaaaacgcgacggtaaaatcgacatcaccatccccattgccaacctgcaaagcggttcgcaacactttaccgaccacctgaaatcagccgacatcttcgatgccgcccaatatccggacatccgctttgtttccaccaaattcaacttcaacggcaaaaaactggtttccgttgacggcaacctgaccatgcacggcaaaaccgcccccgtcaaactcaaagccgaaaaattcaactgctaccaaagcccgatggagaaaaccgaagtttgtggcggcgacttcagcaccaccatcgaccgcaccaaatggggcatggactacctcgttaacgttggtatgaccaaaagcgtccgcatcgacatccaaatcgaggcagccaaacaataa

SEQ ID NO: 38810 - protein, 187 aa, Neisseria meningitidis
MKKIIFAALAAAAISTASAATYKVDEYHANARFAIDHFNTSTNVGGFYGLTGSVEFDQAKRDGKIDITIPIANLQSGSQHFTDHLKSADIFDAAQYPDIRFVSTKFNFNGKKLVSVDGNLTMHGKTAPVKLKAEKFNCYQSPMEKTEVCGGDFSTTIDRTKWGMDYLVNVGMTKSVRIDIQIEAAKQ

SEQ ID NO: 38811 - DNA, 4374 bp, Neisseria meningitidis
atgaaaacaaccgacaaacggacaaccgaaacacaccgcaaagccccgaaaaccggccgcatccgcttctcgcctgcttacttagccatatgcctgtcgttcggcattcttccccaagcctgggcgggacacacttatttcggcatcaactaccaatactatcgcgactttgccgaaaataaaggcaagtttgcagtcggggcgaaagatattgaggtttacaacaaaaaaggggagttggtcggcaaatcaatgacaaaagccccgatgattgatttttctgtggtgtcgcgtaacggcgtggcggcattggtgggcgatcaatatattgtgagcgtggcacataacggcggctataacaacgttgattttggtgcggaaggaagaaatcccgatcaacatcgttttacttataaaattgtgaaacggaataattataaagcagggactaaaggccatccttatggcggcgattatcatatgccgcgtttgcataaatttgtcacagatgcagaacctgttgaaatgaccagttatatggatgggcggaaatatatcgatcaaaataattaccctgaccgtgttcgtattggggcaggcaggcaatattggcgatctgatgaagatgagcccaataaccgcgaaagttcatatcatattgcaagtgcgtattcttggctcgttggtggcaatacctttgcacaaaatggatcaggtggtggcacagtcaacttaggtagtgaaaaaattaaacatagcccatatggttttttaccaacaggaggctcatttggcgacagtggctcaccaatgtttatctatgatgcccaaaagcaaaagtggttaattaatggggtattgcaaacgggcaacccctatataggaaaaagcaatggcttccagctggttcgtaaagattggttctatgatgaaatctttgctggagatacccattcagtattctacgaaccacgtcaaaatgggaaatactcttttaacgacgataataatggcacaggaaaaatcaatgccaaacatgaacacaattctctgcctaatagattaaaaacacgaaccgttcaattgtttaatgtttctttatccgagacagcaagagaacctgtttatcatgctgcaggtggtgtcaacagttatcgacccagactgaataatggagaaaatatttcctttattgacgaaggaaaaggcgaattgatacttaccagcaacatcaatcaaggtgctggaggattatatttccaaggagattttacggtctcgcctgaaaataacgaaacttggcaaggcgcgggcgttcatatcagtgaagacagtaccgttacttggaaagtaaacggcgtggcaaacgaccgcctgtccaaaatcggcaaaggcacgctgcacgttcaagccaaaggggaaaaccaaggctcgatcagcgtgggcgacggtacagtcattttggatcagcaggcagacgataaaggcaaaaaacaagcctttagtgaaatcggcttggtcagcggcaggggtacggtgcaactgaatgccgataatcagttcaaccccgacaaactctatttcggctttcgcggcggacgtttggatttaaacgggcattcgctttcgttccaccgtattcaaaataccgatgaaggggcgatgattgtcaaccacaatcaagacaaagaatccaccgttaccattacaggcaataaagatattgctacaaccggcaataacaacagcttggatagcaaaaaagaaattgcctacaacggttggtttggcgagaaagatacgaccaaaacgaacgggcggctcaaccttgtttaccagcccgccgcagaagaccgcaccctgctgctttccggcggaacaaatttaaacggcaacatcacgcaaacaaacggcaaactgtttttcagcggcagaccaacaccgcacgcctacaatcatttaaacgaccattggtcgcaaaaagagggcattcctcgcggggaaatcgtgtgggacaacgactggatcaaccgcacatttaaagcggaaaacttccaaattaaaggcggacaggcggtggtttcccgcaatgttgccaaagtgaaaggcgattggcatttgagcaatcacgcccaagcagtttttggtgtcgcaccgcatcaaagccacacaatctgtacacgttcggactggacgggtctgacaaattgtgtcgaaaaaaccattaccgacgataaagtgattgcttcattgactaagaccgacatcagcggcaatgtcgatcttgccgatcacgctcatttaaatctcacagggcttgccacactcaacggcaatcttagtgcaaatggcgatacacgttatacagtcagccacaacgccacccaaaacggcaaccttagcctcgtgggcaatgcccaagcaacatttaatcaagccacattaaacggcaacacatcggcttcgggcaatgcttcatttaatctaagcgaccacgccgtacaaaacggcagtctgacgctttccggcaacgctaaggcaaacgtaagccattccgcactcaacggtaatgtctccctagccgataaggcagtattccattttgaaagcagccgctttaccggacaaatcagcggcggcaaggatacggcattacacttaaaagacagcgaatggacgctgccgtcaggcacggaattaggcaatttaaaccttgacaacgccaccattacactcaattccgcctatcgccacgatgcggcaggggcgcaaaccggcagtgcgacagatgcgccgcgccgccgttcgcgccgttcgcgccgttccctattatccgttacaccgccaacttcggtagaatcccgtttcaacacgctgacggtaaacggcaaattgaacggtcagggaacattccgctttatgtcggaactcttcggctaccgcagcgacaaattgaagctggcggaaagttccgaaggcacttacaccttggcggtcaacaataccggcaacgaacctgcaagcctcgaacaattgacggtagtggaaggaaaagacaacaaaccgctgtccgaaaaccttaatttcaccctgcaaaacgaacacgtcgatgccggcgcgtggcgttaccaactcatccgcaaagacggcgagttccgcctgcataatccggtcaaagaacaagagctttccgacaaactcggcaaggcagaagccaaaaaacaggcggaaaaagacaacgcgcaaagccttgacgcgctgattgcggccgggcgcgatgccgtcgaaaagacagaaagcgttgccgaaccggcccggcaggcaggcggggaaaatgtcggcattatgcaggcggaggaagagaaaaaacgggtgcaggcggataaagacaccgccttggcgaaacagcgcgaagcggaaacccggccggctaccaccgccttcccccgcgcccgccgcgcccgccgggatttgccgcaactgcaaccccaaccgcagccccaaccgcagcgcgacctgatcagccgttatgccaatagcggtttgagtgaattttccgccacgctcaacagcgttttcgccgtacaggacgaattagaccgcgtatttgccgaagaccgccgcaacgccgtttggacaagcggcatccgggacaccaaacactaccgttcgcaagatttccgcgcctaccgccaacaaaccgacctgcgccaaatcggtatgcagaaaaacctcggcagcgggcgcgtcggcatcctgttttcgcacaaccggaccgaaaacaccttcgacgacggcatcggcaactcggcacggcttgcccacggcgccgttttcgggcaatacggcatcgacaggttctacatcggcatcagcgcgggcgcgggttttagcagcggcagcctttcagacggcatcggaggcaaaatccgccgccgcgtgctgcattacggcattcaggcacgataccgcgccggtttcggcggattcggcatcgaaccgcacatcggcgcaacgcgctatttcgtccaaaaagcggattaccgctacgaaaacgtcaatatcgccacccccggccttgcattcaaccgctaccgcgcgggcattaaggcagattattcattcaaaccggcgcaacacatttccatcacgccttatttgagcctgtcctataccgatgccgcttcgggcaaagtccgaacacgcgtcaataccgccgtattggctcaggatttcggcaaaacccgcagtgcggaatggggcgtaaacgccgaaatcaaaggtttcacgctgtccctccacgctgccgccgccaaaggcccgcaactggaagcgcaacacagcgcgggcatcaaattaggctaccgctggtaa

SEQ ID NO: 38812 - protein, 1457 aa, Neisseria meningitidis
MKTTDKRTTETHRKAPKTGRIRFSPAYLAICLSFGILPQAWAGHTYFGINYQYYRDFAENKGKFAVGAKDIEVYNKKGELVGKSMTKAPMIDFSVVSRNGVAALVGDQYIVSVAHNGGYNNVDFGAEGRNPDQHRFTYKIVKRNNYKAGTKGHPYGGDYHMPRLHKFVTDAEPVEMTSYMDGRKYIDQNNYPDRVRIGAGRQYWRSDEDEPNNRESSYHIASAYSWLVGGNTFAQNGSGGGTVNLGSEKIKHSPYGFLPTGGSFGDSGSPMFIYDAQKQKWLINGVLQTGNPYIGKSNGFQLVRKDWFYDEIFAGDTHSVFYEPRQNGKYSFNDDNNGTGKINAKHEHNSLPNRLKTRTVQLFNVSLSETAREPVYHAAGGVNSYRPRLNNGENISFIDEGKGELILTSNINQGAGGLYFQGDFTVSPENNETWQGAGVHISEDSTVTWKVNGVANDRLSKIGKGTLHVQAKGENQGSISVGDGTVILDQQADDKGKKQAFSEIGLVSGRGTVQLNADNQFNPDKLYFGFRGGRLDLNGHSLSFHRIQNTDEGAMIVNHNQDKESTVTITGNKDIATTGNNNSLDSKKEIAYNGWFGEKDTTKTNGRLNLVYQPAAEDRTLLLSGGTNLNGNITQTNGKLFFSGRPTPHAYNHLNDHWSQKEGIPRGEIVWDNDWINRTFKAENFQIKGGQAVVSRNVAKVKGDWHLSNHAQAVFGVAPHQSHTICTRSDWTGLTNCVEKTITDDKVIASLTKTDISGNVDLADHAHLNLTGLATLNGNLSANGDTRYTVSHNATQNGNLSLVGNAQATFNQATLNGNTSASGNASFNLSDHAVQNGSLTLSGNAKANVSHSALNGNVSLADKAVFHFESSRFTGQISGGKDTALHLKDSEWTLPSGTELGNLNLDNATITLNSAYRHDAAGAQTGSATDAPRRRSRRSRRSLLSVTPPTSVESRFNTLTVNGKLNGQGTFRFMSELFGYRSDKLKLAESSEGTYTLAVNNTGNEPASLEQLTVVEGKDNKPLSENLNFTLQNEHVDAGAWRYQLIRKDGEFRLHNPVKEQELSDKLGKAEAKKQAEKDNAQSLDALIAAGRDAVEKTESVAEPARQAGGENVGIMQAEEEKKRVQADKDTALAKQREAETRPATTAFPRARRARRDLPQLQPQPQPQPQRDLISRYANSGLSEFSATLNSVFAVQDELDRVFAEDRRNAVWTSGIRDTKHYRSQDFRAYRQQTDLRQIGMQKNLGSGRVGILFSHNRTENTFDDGIGNSARLAHGAVFGQYGIDRFYIGISAGAGFSSGSLSDGIGGKIRRRVLHYGIQARYRAGFGGFGIEPHIGATRYFVQKADYRYENVNIATPGLAFNRYRAGIKADYSFKPAQHISITPYLSLSYTDAASGKVRTRVNTAVLAQDFGKTRSAEWGVNAEIKGFTLSLHAAAAKGPQLEAQHSAGIKLGYRW

SEQ ID NO: 38813 - DNA, 1827 bp, Neisseria meningitidis
ttgggcatttcccgcaaaatatcccttattctgtccatactggcagtgtgcctgccgatgcatgcacacgcctcagatttggcaaacgattcttttatccggcaggttctcgaccgtcagcatttcgaacccgacgggaaataccacctattcggcagcaggggggaacttgccgagcgcagcggccatatcggattgggaaaaatacaaagccatcagttgggcaacctgatgattcaacaggcggccattaaaggaaatatcggctacattgtccgcttttccgatcacgggcacgaagtccattcccccttcgacaaccatgcctcacattccgattctgatgaagccggtagtcccgttgacggatttagcctttaccgcatccattgggacggatacgaacaccatcccgccgacggctatgacgggccacagggcggcggctatcccgctcccaaaggcgcgagggatatatacagctacgacataaaaggcgttgcccaaaatatccgcctcaacctgaccgacaaccgcagcaccggacaacggcttgccgaccgtttccacaatgccggtagtatgctgacgcaaggagtaggcgacggattcaaacgcgccacccgatacagccccgagctggacagatcgggcaatgccgccgaagccttcaacggcactgcagatatcgttaaaaacatcatcggcgcggcaggagaaattgtcggcgcaggcgatgccgtgcagggcataagcgaaggctcaaacattgctgtcatgcacggcttgggtctgctttccaccgaaaacaagatggcgcgcatcaacgatttggcagatatggcgcaactcaaagactatgccgcagcagccatccgcgattgggcagtccaaaaccccaatgccgcacaaggcatagaagccgtcagcaatatctttatggcagccatccccatcaaagggattggagctgttcggggaaaatacggcttgggcggcatcacggcacatcctatcaagcggtcgcagatgggcgcgatcgcattgccgaaagggaaatccgccgtcagcgacaattttgccgatgcggcatacgccaaatacccgtccccttaccattcccgaaatatccgttcaaacttggagcagcgttacggcaaagaaaacatcacctcctcaaccgtgccgccgtcaaacggcaaaaatgtcaaactggcagaccaacgccacccgaagacaggcgtaccgtttgacggtaaagggtttccgaattttgagaagcacgtgaaatatgatacgaagctcgatattcaagaattatcggggggcggtatacctaaggctaagcctgtgtttgatgcgaaaccgagatgggaggttgataggaagcttaataaattgacaactcgtgagcaggtggagaaaaatgttcaggaaataaggaacggtaatataaacagtaactttagccaacatgctcaactagagagggaaattaataaactaaaatctgccgatgaaattaattttgcagatggaatgggaaaatttaccgatagcatgaatgacaaggcttttagtaggcttgtgaaatcagttaaagagaatggcttcacaaatccagttgtggagtacgttgaaataaatggaaaagcatatatcgtaagaggaaataatrgggtttttgctgcagaataccttggcaggatacatgaattaaaatttaaaaaagttgactttcctgttcctaatactagttggaaaaatcctactgatgtcttgaatgaatcaggtaatgttaagagacctcgttataggagtaaataa

SEQ ID NO: 38814 - protein, 608 aa, Neisseria meningitidis
LGISRKISLILSILAVCLPMHAHASDLANDSFIRQVLDRQHFEPDGKYHLFGSRGELAERSGHIGLGKIQSHQLGNLMIQQAAIKGNIGYIVRFSDHGHEVHSPFDNHASHSDSDEAGSPVDGFSLYRIHWDGYEHHPADGYDGPQGGGYPAPKGARDIYSYDIKGVAQNIRLNLTDNRSTGQRLADRFHNAGSMLTQGVGDGFKRATRYSPELDRSGNAAEAFNGTADIVKNIIGAAGEIVGAGDAVQGISEGSNIAVMHGLGLLSTENKMARINDLADMAQLKDYAAAAIRDWAVQNPNAAQGIEAVSNIFMAAIPIKGIGAVRGKYGLGGITAHPIKRSQMGAIALPKGKSAVSDNFADAAYAKYPSPYHSRNIRSNLEQRYGKENITSSTVPPSNGKNVKLADQRHPKTGVPFDGKGFPNFEKHVKYDTKLDIQELSGGGIPKAKPVFDAKPRWEVDRKLNKLTTREQVEKNVQEIRNGNINSNFSQHAQLEREINKLKSADEINFADGMGKFTDSMNDKAFSRLVKSVKENGFTNPVVEYVEINGKAYIVRGNNRVFAAEYLGRIHELKFKKVDFPVPNTSWKNPTDVLNESGNVKRPRYRSK

SEQ ID NO: 38815 - DNA, 33 bp, Neisseria meningitidis;
cgcggatcccatatgttgcctgcaatcacgatt

SEQ ID NO: 38816 - protein, 28 aa, Neisseria meningitidis
CCCGCTCGAGTTTAGAAGCGGGCGGCAA

SEQ ID NO: 38817 - DNA, 34 bp, Neisseria meningitidis
cgcggatcccatatgttcaaatcctttgtcgtca

SEQ ID NO: 38818 - protein, 27 aa, Neisseria meningitidis
CCCGCTCGAGTTTGGCGGTTTTGCTGC

SEQ ID NO: 38819 - DNA, 30 bp, Neisseria meningitidis
cgcggatcccatatggccgcccccgcatct

SEQ ID NO: 38820 - protein, 31 aa, Neisseria meningitidis
CCCGCTCGAGATTTACTTTTTTGATGTCGAC

SEQ ID NO: 38821 - DNA, 33 bp, Neisseria meningitidis
cgcggatcccatatgtgccaaagcaagagcatc

SEQ ID NO: 38822 - protein, 25 aa, Neisseria meningitidis
CCCGCTCGAGCGGGCGGTATTCGGG

SEQ ID NO: 38823 - DNA, 32 bp, Neisseria meningitidis
cgcggatcccatatggaaacacagctttacat

SEQ ID NO: 38824 - protein, 29 aa, Neisseria meningitidis
CCCGCTCGAGATAATAATATCCCGCGCCC

SEQ ID NO: 38825 - DNA, 29 bp, Neisseria meningitidis
cgcggatcccatatgactgacaacgcact

SEQ ID NO: 38826 - protein, 26 aa, Neisseria meningitidis
CCCGCTCGAGGACCGCGTTGTCGAAA

SEQ ID NO: 38827 - DNA, 31 bp, Neisseria meningitidis
cgcggatcccatatgaaacaccgccaaccga

SEQ ID NO: 38828 - protein, 31 aa, Neisseria meningitidis
CCCGCTCGAGTTCTGTAAAAAAAGTATGTGC

SEQ ID NO: 38829 - DNA, 32 bp, Neisseria meningitidis
ccggaattctagctagcctttcagcctgcggg

SEQ ID NO: 38830 - protein, 28 aa, Neisseria meningitidis
CCCGCTCGAGATCCTGCTCTTTTTTGCC

SEQ ID NO: 38831 - DNA, 31 bp, Neisseria meningitidis
cgcggatcccatatgtgcgggacactgacag

SEQ ID NO: 38832 - protein, 28 aa, Neisseria meningitidis
CCCGCTCGAGAGGTTGTCCTTGTCTATG
